United States Patent 11,931,406 (FLAVIVIRUS VACCINE) - sequence listing, part 24

SEQ ID NO: 10412 - RNA, 9873 nt, Artificial Sequence
  derived and/or modified CDS sequence (opt1) from DENV-3__AY744683__SS-prME
accagccugugccucaugaugaugcugcccgccacccuggccuuccaccucaccagccgcgacggcgagccccggaugaucguggggaagaacgagcgcggcaagagccugcuguucaagaccgccagcgggaucaacaugugcacccucaucgccauggaccugggcgagaugugcgacgacaccgugaccuacaagugcccccugaucaccgagguggagcccgaggacaucgacugcuggugcaaccucaccagcaccugggugaccuacgggaccugcaaccaggccggcgagcaccggcgcgacaagcggagcguggcccuggcgccccacgugggcauggggcuggacacccgcacccagaccuggaugagcgcggagggcgccuggcggcaggucgagaaggucgagaccugggccuuccgccaccccggguucaccauccucgcccuguuccuggcgcacuacaucggcaccucccucacccagaagguggugaucuucauccugcugaugcucgucacccccagcaugaccaugcggugcgugggggugggcaaccgcgacuucgucgagggccuguccggggccaccuggguggacgugguccuggagcacggcgggugcgugacgaccauggccaagaacaagcccacccucgacaucgagcugcagaagaccgaggccacgcagcuggccacccuccggaagcugugcaucgagggcaagaucaccaacgugaccacggacagccgcugccccacccagggcgaggcgauccugcccgaggagcaggaccagaacuacgucugcaagcacaccuacguggaccggggguggggcaacgggugcggccucuucgggaagggcucccuggugaccugcgccaaguuccagugccuggagagcaucgagggcaaggccguccagcacgagaaccucaaguacacggugaucaucaccgugcacaccggggaccagcaccaggucggcaacgagacccagggggugacggccgagaucacgccccaggccuccaccgucgaggcgauccugcccgaguacggcacccuggggcucgagugcagcccccgcaccggccuggacuucaacgagaugauccugcucacgaugaagaacaaggccuggauggugcaccggcagugguucuucgaccugccgcugcccuggaccuccggcgccaccaccgagacgcccaccuggaacaagaaggagcuccuggugaccuucaagaacgcccacgccaagaagcaggaggucguggugcuggggagccaggagggcgcgaugcacaccgcccucacgggggccaccgagauccagaccuccggcgggaccagcaucuucgccggccaccugaagugccgccugaagauggacaagcucgagcugaagggcauguccuacgccaugugccugaacgcguucguccucaagaaggaggugagcgagacgcagcacgggaccauccugaucaagguggaguacaagggcgaggacgcccccugcaagaucccguucagcaccgaggacgggcagggcaaggcccacaacggccggcugaucaccgccaaccccaucgucacgaagaaggaggagcccgugaacaucgaggcggagcccccguucggggaguccaacaucgugaucggcaucggggacaaggcccugaagaucaacugguacaagaagggcagcuccaucgggaagauguucgaggccaccgcccgcggcgcccggcgcauggcgauccucggcgacaccgccugggacuucgggagcgucggcggggugcugaacucccugggcaagauggugcaccagaucuucgggagcgccuacaccgcccucuucuccggcgucagcuggaucaugaagaucggcaucggggugcugcugacguggaucggccucaacuccaagaacaccagcauguccuucagcugcaucgugaucgggaucaucacccuguaccugggcgccgucgugcaggcggacauggggugcgugaucaacuggaagggcaaggagcucaagugcggcuccgggaucuucgucaccaacgaggugcacacguggaccgagcaguacaaguuccaggccgacagccccaagcggcuggccaccgccaucgccggcgcgugggagaacggggugugcggcauccgcuccaccacgcgcauggagaaccugcucuggaagcagaucgccaacgagcugaacuacauccugugggagaacaacaucaagcucaccaucgucgugggggacgugaucggcguccuggagcagggcaagcggacccugacgccccagcccauggagcucaaguacagcuggaagacgugggggaaggccaagaucgugaccgccgagacccagaacuccagcuucaucaucgacggcccgaacacccccgagugccccuccgcgagccgcgccuggaacgugugggaggucgaggacuacggguucggcguguucacgaccaacaucuggcugaagcugcgggagauguacacccagcucugcgaccaccgccugaugagcgccgccgugaaggacgagcgggccguccacgcggacaugggcuacuggaucgagucccagaagaacgggagcuggaagcuggagaaggccucccucaucgaggugaagaccugcaccuggcccaagagccacacgcugugguccaacggcgugcuggagagcgacaugaucaucccgaagucccucgccgggcccaucagccagcacaacuaccgccccggcuaccacacccagaccgccgggccguggcaccugggcaagcuggagcucgacuucaacuacugcgagggcaccacggucgugaucaccgagaacugcgggacccggggccccucccugcgcaccacgaccgugagcgggaagcugauccacgaguggugcugccgguccugcacccugccgccccuccgcuacaugggcgaggacgggugcugguacggcauggagauccggccgaucaacgagaaggaggagaacauggucaagagccugguguccgccggcagcgggaaggcggacaacuucaccaugggcgugcucugccuggccauccuguucgaggaggucaugcgcgggaaguucggcaagaagcacaugaucgccggggcccucuucacguucgugcugcugcucuccggccagaucaccuggcgggacauggcccacacccugaucaugaucggcagcaacgcguccgaccgcauggggaugggcgugaccuaccuggcccucaucgccacguucaagauccagcccuuccuggcccugggguucuuccuccggaagcugaccagccgcgagaaccugcuccugggcgucggccuggcgauggccaccacccuccagcugcccgaggacaucgagcagauggccaacgggaucgcccugggccucauggcccugaagcugaucacgcaguucgagaccuaccagcucuggaccgcgcuggugagccugaugugcuccaacaccaucuucacgcucaccguggccuggcggaccgccacccugauccuggccgucaucagccuccugcccgugugccaguccagcuccaugcgcaagacggacuggcugccgaugaccguggccgcgaugggggugccgccccucccccuguucaucuucagccugaaggacacccucaagcggcgcuccuggccgcugaacgagggcgugauggccgucgggcuggugagcauccucgccuccagcuuccugcgcaacgacgugcccauggccggcccccuggucgccggcgggcuccugaucgcgugcuacgugaucaccggcacguccgccgaccugaccguggagaaggccgccgacgucaccugggaggaggaggccgagcagaccggggugagccacaaccucaugaucacgguggacgacgacggcaccaugcggaucaaggacgacgagaccgagaacauccugaccguccugcucaagaccgcgcugcugaucguguccgggaucuuccccuacagcaucccggccacgcuccugguguggcacaccuggcagaagcagacccagcgcuccggcguccugugggacgugcccuccccgcccgagacccagaaggccgagcucgaggagggcguguaccggaucaagcagcaggggaucuucggcaagacgcaggucggggugggcgugcagaaggagggggucuuccacaccauguggcacgugacccgcggcgccgugcugacccacaacggcaagcggcuggagccgaacugggcgaacgucaagaaggaccucaucuccuacgggggcggguggaagcugagcgcccaguggcagaagggcgaggagguccaggugaucgccgucgagcccgggaagaaccccaagaacuuccagacgaugcccggcaucuuccagaccaccaccggcgagaucggggccaucgcccuggacuucaagccgggcacguccgggagccccaucaucaaccgcgagggcaagguggugggccuguacgggaacggcgucgugaccaagaacgggggcuacgugagcgggaucgcgcagaccaacgccgagcccgacggcccgacccccgagcucgaggaggagauguucaagaagcggaaccugacgaucauggaccugcaccccggcuccgggaagacccgcaaguaccuccccgccaucguccgggaggccaucaagcgccggcugcgcacccugauccucgccccgacccgggugguggcggccgagauggaggaggcccugaagggccugcccauccgcuaccagacgaccgccaccaagagcgagcacaccgggcgggagaucgucgaccucaugugccacgccacguucaccaugcgccugcugucccccgugcgggugcccaacuacaaccucaucgucauggacgaggcgcacuucaccgacccggccagcaucgccgcccgcggcuacaucuccacccggguggggaugggcgaggcggccgccaucuucaugacggccacgccgcccggcaccgccgacgcguucccccagagcaacgccccgauccaggacgaggagcgcgacauccccgagcgguccuggaacagcgggaacgaguggaucaccgacuucgccggcaagacggugugguucguccccuccaucaaggccgggaacgacaucgccaacugccugcgcaagaacggcaagaaggugauccagcugagccgcaagaccuucgacaccgaguaccagaagaccaagcucaacgacugggacuucguggucacgaccgacaucuccgagaugggggcgaacuucaaggccgaccgggugaucgacccccgccggugccugaagccggugauccugaccgacggccccgagcgcgucauccucgccggccccaugcccgugaccguggccagcgccgcgcagcggcgcgggcgggucggccgcaacccgcagaaggagaacgaccaguacaucuucacggggcagccccugaacaacgacgaggaccacgcccacuggaccgaggccaagaugcugcucgacaacaucaacacccccgagggcaucauccccgcccuguucgagccggagcgggagaaguccgcggccaucgacggggaguaccgccugaagggcgagagccggaagaccuucguggagcucaugcgccggggcgaccugcccguguggcuggcccacaaggucgccuccgaggggaucaaguacaccgaccgcaaguggugcuucgacggcgagcggaacaaccagauccucgaggagaacauggacguggagaucuggacgaaggagggggagaagaagaagcugcgcccccgguggcuggacgcccgcaccuacagcgacccccucgcgcugaaggaguucaaggacuucgccgccggccggaaguccaucgcccuggaccucgucaccgagaucggccgcgugccgagccaccuggcccaccgcacccggaacgcgcuggacaaccucgugaugcugcacacguccgagcacgggggccgcgccuaccggcacgccgucgaggagcugcccgagaccauggagacccuccugcugcucgggcugaugauccugcucaccggcggggccaugcuguuccugaucagcggcaagggcaucgggaagacgagcaucggccucaucugcgugguggccuccagcgggaugcuguggauggcggacgucccccugcaguggaucgccuccgccaucgugcucgaguucuucaugauggugcugcugaucccggagcccgagaagcagcgcacgccccaggacaaccagcucgccuacgucgugaucggcauccugacccuggccgcgaucguggccgccaacgagauggggcuccuggagaccacgaagcgggaccugggcaugagcaaggagcccggcgucguguccccgaccagcuaccucgacguggaccugcaccccgccuccgcguggacccuguacgccgucgccaccacggugaucacccccaugcuccgccacaccaucgagaacagcaccgccaacgugucccuggccgcgaucgccaaccaggccgucgugcugauggggcucgacaagggcuggcccaucagcaagauggaccugggggugccgcugcucgcccugggcugcuacucccaggucaacccccugacgcucaccgccgcggugcugcugcucgugacccacuacgccaucaucgggcccggccugcaggccaaggccacccgggaggcccagaagcgcacggcggccggcaucaugaagaaccccaccgucgacgggaucaugaccaucgaccuggacccggugaucuacgacagcaaguucgagaagcagcucggccaggugaugcugcugguccucugcgccgugcagcugcugcucaugcggaccuccugggccuucugcgaggcgcugacgcuggccaccgggcccaucaccacccucugggagggcagccccggcaaguucuggaacacgaccaucgccguguccauggccaacaucuuccgcgggagcuaccuggccggcgcggggcuggccuucuccaucaugaaguccgucggcaccgggaagcggggcaccggcucccagggggagacgcucggcgagaaguggaagaagaagcugaaccagcugagccgcaaggaguucgaccucuacaagaaguccgggaucaccgagguggaccggaccgaggccaaggagggccugaagcgcggggagaucacccaccacgccgugucccggggcagcgccaagcugcagugguucgucgagcgcaacauggugauccccgagggccgggugaucgaccucgggugcggccgcgggggcugguccuacuacugcgcggggcugaagaaggucaccgaggugcggggcuacacgaagggcgggccgggccacgaggagcccgugcccaugagcaccuacggguggaacaucgucaagcugauguccggcaaggacguguucuaccucccgcccgagaagugcgacacccugcugugcgacaucggggagagcucccccagccccaccguggaggagucccgcacgauccggguccugaagaugguggagcccuggcucaagaacaaccaguucugcaucaaggugcugaaccccuacaugcccaccgucaucgagcaccuggagcgccuccagcgcaagcacggcggcaugcuggugcggaacccccugagccgcaacuccacccacgagauguacuggaucagcaacgggaccggcaacaucguguccagcgucaacauggugucccggcuccugcugaaccgcuucacgaugacccaccggcgccccaccaucgagaaggacguggaccucggggccggcacccggcacgucaacgccgagccggagacgcccaacauggacgugaucggcgagcgcauccggcgcaucaaggaggagcacagcuccaccuggcacuacgacgacgagaaccccuacaagaccugggccuaccacgggagcuacgaggucaaggccaccggcuccgcgagcagcaugaucaacgggguggugaagcugcugacgaagccgugggacgucgugcccauggugacccagauggccaugaccgacaccacgcccuucggccagcagcgggucuucaaggagaagguggacacccgcacgccccggccgaugcccgggacccgcaaggugauggagaucacggccgaguggcucuggcggacccugggccgcaacaagcggccccgccugugcacccgggaggaguucaucaagaagguccgcaccaacgccgcgaugggcgccguguucacggaggagaaccagugggacuccgcccgcgccgccguggaggacgaggaguucuggaagcucgucgaccgggagcgcgagcugcacaagcuggggaagugcggcagcugcguguacaacaugauggggaagcgggagaagaagcucggcgaguucgggaaggcgaagggcucccgcgccaucugguacauguggcugggcgcccgguuccuggaguucgaggcccucggguuccugaacgaggaccacugguucagccgcgagaacuccuacagcggcguggagggggagggccugcacaagcucggguacauccugcgggacaucuccaagauccccggcggcgccauguacgcggacgacaccgccgggugggacacccgcaucaccgaggacgaccugcacaacgaggagaagaucacgcagcagauggacccggagcaccggcagcucgccaacgccaucuucaagcugaccuaccagaacaaggucgugaaggugcagcgccccacccccaagggcaccgucauggacaucaucagccggaaggaccagcgcggguccggccaggugggcacguacgggcugaacaccuucaccaacauggaggcccagcucauccggcagauggagggcgagggggugcugagcaaggcggaccuggagaacccccaccuccuggagaagaaggucacccaguggcuggagaccaagggcguggagcgccucaagcggauggccaucuccggggacgacugcguggucaagccgaucgacgaccgcuucgccaacgcccugcuggcccucaacgacaugggcaaggugcggaaggacaucccccaguggcagcccagcaagggcuggcacgacuggcagcagguccccuucugcucccaccacuuccacgagcugaucaugaaggacgggcgcaagcuggucgugccgugccggccccaggacgagcucaucggccgcgcgcggaucagccagggggccggcuggucccugcgcgagacggccugccuggggaaggccuacgcgcagaugugggcccucauguacuuccaccgccgggaccugcgccuggccagcaacgccaucugcuccgccgugcccguccacugggugcccaccagccggaccaccugguccauccacgcgcaccaccaguggaugacgaccgaggacaugcucaccguguggaaccgcgucuggaucgaggacaacccguggauggaggacaagacccccgugacgaccugggaggacgugcccuaccugggcaagcgggaggaccaguggugcggcagccugaucgggcucaccagccgcgccaccugggcccagaacauccugacggccauccagcagguccggucccugaucggcaacgaggaguuccucgacuacaugcccagcaugaagcgcuuccggaaggaggaggaguccgagggggccaucugguga

SEQ ID NO: 10413 - RNA, 9873 nt, Artificial Sequence
  derived and/or modified CDS sequence (opt1) from DENV-3__AY744684__SS-prME
accagccugugccucaugaugaugcugcccgccacccuggccuuccaccucaccucccgcgacggcgagccccggaugaucguggggaagaacgagcgcggcaagagccugcuguucaagaccgccuccgggaucaacaugugcacccucaucgccauggaccugggcgagaugugcgacgacaccgugaccuacaagugcccccugaucaccgagguggagcccgaggacaucgacugcuggugcaaccucaccagcaccugggugaccuacgggaccugcaaccaggccggcgagcaccggcgcgacaagcgguccguggcccuggcgccccacgugggcauggggcuggacacccgcacccagaccuggaugagcgcggagggcgccuggcggcaggucgagaaggucgagaccugggccuuccgccaccccggguucaccauccucgcccuguuccuggcgcacuacaucggcaccucccucacccagaagguggugaucuucauccugcugaugcucgucacccccagcaugaccaugcggugcgugggggugggcaaccgcgacuucgucgagggccuguccggggccaccuggguggacgugguccuggagcacggcgggugcgugacgaccauggccaagaacaagcccacccucgacaucgagcugcagaagaccgaggccacgcagcuggccacccuccggaagcugugcaucgagggcaagaucaccaacgugaccacggacagccgcugccccacccagggcgaggcgauccugcccgaggagcaggaccagaacuacgucugcaagcacaccuacguggaccggggguggggcaacgggugcggccucuucgggaagggcucccuggugaccugcgccaaguuccagugccuggagagcaucgagggcaaggccguccagcacgagaaccucaaguacacggugaucaucaccgugcacaccggggaccagcaccaggucggcaacgagacccagggggugacggccgagaucacgccccaggccuccaccgucgaggcgauccugcccgaguacggcacccuggggcucgagugcagcccccgcaccggccuggacuucaacgagaugauccugcucacgaugaagaacaaggccuggauggugcaccggcagugguucuucgaccugccgcugcccuggaccuccggcgccaccaccgagacgcccaccuggaacaagaaggagcuccuggugaccuucaagaacgcccacgccaagaagcaggaggucguggugcuggggagccaggagggcgcgaugcacaccgcccucacgggggccaccgagauccagaccuccggcgggaccagcaucuucgccggccaccugaagugccgccugaagauggacaagcucgagcugaagggcauguccuacgccaugugccugaacgcguucguccucaagaaggaggugagcgagacgcagcacgggaccauccugaucaagguggaguacaagggcgaggacgcccccugcaagaucccguucagcaccgaggacgggcagggcaaggcccacaacggccggcugaucaccgccaaccccaucgucacgaagaaggaggagcccgugaacaucgaggcggagcccccguucggggaguccaacaucgugaucggcaucggggacaaggcccugaagaucaacugguacaagaagggcagcuccaucgggaagauguucgaggccaccgcccgcggcgcccggcgcauggcgauccucggcgacaccgccugggacuucgggagcgucggcggggugcugaacucccugggcaagauggugcaccagaucuucgggagcgccuacaccgcccucuucuccggcgucagcuggaucaugaagaucggcaucggggugcugcugacguggaucggccucaacuccaagaacaccagcauguccuucagcugcaucgugaucgggaucaucacccuguaccugggcgccgucgugcaggcggacauggggugcgugaucaacuggaagggcaaggagcucaagugcggcuccgggaucuucgucaccaacgaggugcacacguggaccgagcaguacaaguuccaggccgacagccccaagcggcuggccaccgccaucgccggcgcgugggagaacggggugugcggcauccgcuccaccacgcgcauggagaaccugcucuggaagcagaucgccaacgagcugaacuacauccugugggagaacaacaucaagcucaccaucgucgugggggacgugaucggcguccuggagcagggcaagcggacccugacgccccagcccauggagcucaaguacagcuggaagacgugggggaaggccaagaucgugaccgccgagacccagaacuccagcuucaucaucgacggcccgaacacccccgagugccccuccgcgagccgcgccuggaacgugugggaggucgaggacuacggguucggcguguucacgaccaacaucuggcugaagcugcgggagauguacacccagcucugcgaccaccgccugaugagcgccgccgugaaggacgagcgggccguccacgcggacaugggcuacuggaucgagucccagaagaacgggagcuggaagcuggagaaggccucccucaucgaggugaagaccugcaccuggcccaagagccacacgcugugguccaacggcgugcuggagagcgacaugaucaucccgaagucccucgccgggcccaucagccagcacaacuaccgccccggcuaccacacccagaccgccgggccguggcaccugggcaagcuggagcucgacuucaacuacugcgagggcaccacggucgugaucaccgagaacugcgggacccggggccccucccugcgcaccacgaccgugagcgggaagcugauccacgaguggugcugccgguccugcacccugccgccccuccgcuacaugggcgaggacgggugcugguacggcauggagauccggccgaucaacgagaaggaggagaacauggucaagagccugguguccgccggcagcgggaaggcggacaacuucaccaugggcgugcucugccuggccauccuguucgaggaggucaugcgcgggaaguucggcaagaagcacaugaucgccggggcccucuucacguucgugcugcugcucuccggccagaucaccuggcgggacauggcccacacccugaucaugaucggcagcaacgcguccgaccgcauggggaugggcgugaccuaccuggcccucaucgccacguucaagauccagcccuuccuggcccugggguucuuccuccggaagcugaccagccgcgagaaccugcuccugggcgucggccuggcgauggccaccacccuccagcugcccgaggacaucgagcagauggccaacgggaucgcccugggccucauggcccugaagcugaucacgcaguucgagaccuaccagcucuggaccgcgcuggugagccugaugugcuccaacaccaucagcacgcucaccguggccuggcggaccgccacccugauccuggccgucaucucccuccugcccgugugccagagcuccagcaugcgcaagacggacuggcugccgaugaccguggccgcgaugggggugccgccccucccccuguucaucuucucccugaaggacacccucaagcggcgcagcuggccgcugaacgagggcgugauggccgucgggcugguguccauccucgccagcuccuuccugcgcaacgacgugcccauggccggcccccuggucgccggcgggcuccugaucgcgugcuacgugaucaccggcacgagcgccgaccugaccguggagaaggccgccgacgucaccugggaggaggaggccgagcagaccggggugucccacaaccucaugaucacgguggacgacgacggcaccaugcggaucaaggacgacgagaccgagaacauccugaccguccugcucaagaccgcgcugcugaucgugagcgggaucuuccccuacuccaucccggccacgcuccugguguggcacaccuggcagaagcagacccagcgcagcggcguccugugggacgugcccagcccgcccgagacccagaaggccgagcucgaggagggcguguaccggaucaagcagcaggggaucuucggcaagacgcaggucggggugggcgugcagaaggagggggucuuccacaccauguggcacgugacccgcggcgccgugcugacccacaacggcaagcggcuggagccgaacugggcgaacgucaagaaggaccucaucagcuacgggggcggguggaagcuguccgcccaguggcagaagggcgaggagguccaggugaucgccgucgagcccgggaagaaccccaagaacuuccagacgaugcccggcaucuuccagaccaccaccggcgagaucggggccaucgcccuggacuucaagccgggcacgagcgggagccccaucaucaaccgcgagggcaagguggugggccuguacgggaacggcgucgugaccaagaacgggggcuacguguccgggaucgcgcagaccaacgccgagcccgacggcccgacccccgagcucgaggaggagauguucaagaagcggaaccugacgaucauggaccugcaccccggcagcgggaagacccgcaaguaccuccccgccaucguccgggaggccaucaagcgccggcugcgcacccugauccucgccccgacccgggugguggcggccgagauggaggaggcccugaagggccugcccauccgcuaccagacgaccgccaccaaguccgagcacaccgggcgggagaucgucgaccucaugugccacgccacguucaccaugcgccugcugagccccgugcgggugcccaacuacaaccucaucgucauggacgaggcgcacuucaccgacccggccuccaucgccgcccgcggcuacaucagcacccggguggggaugggcgaggcggccgccaucuucaugacggccacgccgcccggcaccgccgacgcguucccccaguccaacgccccgauccaggacgaggagcgcgacauccccgagcggagcuggaacuccgggaacgaguggaucaccgacuucgccggcaagacggugugguucguccccagcaucaaggccgggaacgacaucgccaacugccugcgcaagaacggcaagaaggugauccagcugucccgcaagaccuucgacaccgaguaccagaagaccaagcucaacgacugggacuucguggucacgaccgacaucagcgagaugggggcgaacuucaaggccgaccgggugaucgacccccgccggugccugaagccggugauccugaccgacggccccgagcgcgucauccucgccggccccaugcccgugaccguggccuccgccgcgcagcggcgcgggcgggucggccgcaacccgcagaaggagaacgaccaguacaucuucacggggcagccccugaacaacgacgaggaccacgcccacuggaccgaggccaagaugcugcucgacaacaucaacacccccgagggcaucauccccgcccuguucgagccggagcgggagaaguccgcggccaucgacggggaguaccgccugaagggcgagagccggaagaccuucguggagcucaugcgccggggcgaccugcccguguggcuggcccacaaggucgccagcgaggggaucaaguacaccgaccgcaaguggugcuucgacggcgagcggaacaaccagauccucgaggagaacauggacguggagaucuggacgaaggagggggagaagaagaagcugcgcccccgguggcuggacgcccgcaccuacuccgacccccucgcgcugaaggaguucaaggacuucgccgccggccggaaguccaucgcccuggaccucgucaccgagaucggccgcgugccgucccaccuggcccaccgcacccggaacgcgcuggacaaccucgugaugcugcacacgagcgagcacgggggccgcgccuaccggcacgccgucgaggagcugcccgagaccauggagacccuccugcugcucgggcugaugauccugcucaccggcggggccaugcuguuccugaucagcggcaagggcaucgggaagacguccaucggccucaucugcgugguggccagcuccgggaugcuguggauggcggacgucccccugcaguggaucgccagcgccaucgugcucgaguucuucaugauggugcugcugaucccggagcccgagaagcagcgcacgccccaggacaaccagcucgccuacgucgugaucggcauccugacccuggccgcgaucguggccgccaacgagauggggcuccuggagaccacgaagcgggaccugggcauguccaaggagcccggcgucgugagcccgaccuccuaccucgacguggaccugcaccccgccagcgcguggacccuguacgccgucgccaccacggugaucacccccaugcuccgccacaccaucgagaacuccaccgccaacgugagccuggccgcgaucgccaaccaggccgucgugcugauggggcucgacaagggcuggcccaucuccaagauggaccugggggugccgcugcucgcccugggcugcuacagccaggucaacccccugacgcucaccgccgcggugcugcugcucgugacccacuacgccaucaucgggcccggccugcaggccaaggccacccgggaggcccagaagcgcacggcggccggcaucaugaagaaccccaccgucgacgggaucaugaccaucgaccuggacccggugaucuacgacuccaaguucgagaagcagcucggccaggugaugcugcugguccucugcgccgugcagcugcugcucaugcggaccagcugggccuucugcgaggcgcugacgcuggccaccgggcccaucaccacccucugggagggcucccccggcaaguucuggaacacgaccaucgccgugagcauggccaacaucuuccgcggguccuaccuggccggcgcggggcuggccuucagcaucaugaaguccgucggcaccgggaagcggggcaccggcagccagggggagacgcucggcgagaaguggaagaagaagcugaaccagcugagccgcaaggaguucgaccucuacaagaaguccgggaucaccgagguggaccggaccgaggccaaggagggccugaagcgcggggagaucacccaccacgccgugagccggggcuccgccaagcugcagugguucgucgagcgcaacauggugauccccgagggccgggugaucgaccucgggugcggccgcgggggcuggagcuacuacugcgcggggcugaagaaggucaccgaggugcggggcuacacgaagggcgggccgggccacgaggagcccgugcccauguccaccuacggguggaacaucgucaagcugaugagcggcaaggacguguucuaccucccgcccgagaagugcgacacccugcugugcgacaucggggaguccagccccucccccaccguggaggagagccgcacgauccggguccugaagaugguggagcccuggcucaagaacaaccaguucugcaucaaggugcugaaccccuacaugcccaccgucaucgagcaccuggagcgccuccagcgcaagcacggcggcaugcuggugcggaacccccugucccgcaacagcacccacgagauguacuggaucuccaacgggaccggcaacaucgugagcuccgucaacauggugagccggcuccugcugaaccgcuucacgaugacccaccggcgccccaccaucgagaaggacguggaccucggggccggcacccggcacgucaacgccgagccggagacgcccaacauggacgugaucggcgagcgcauccggcgcaucaaggaggagcacuccagcaccuggcacuacgacgacgagaaccccuacaagaccugggccuaccacggguccuacgaggucaaggccaccggcagcgcgagcuccaugaucaacgggguggugaagcugcugacgaagccgugggacgucgugcccauggugacccagauggccaugaccgacaccacgcccuucggccagcagcgggucuucaaggagaagguggacacccgcacgccccggccgaugcccgggacccgcaaggugauggagaucacggccgaguggcucuggcggacccugggccgcaacaagcggccccgccugugcacccgggaggaguucaucaagaagguccgcaccaacgccgcgaugggcgccguguucacggaggagaaccagugggacagcgcccgcgccgccguggaggacgaggaguucuggaagcucgucgaccgggagcgcgagcugcacaagcuggggaagugcggcuccugcguguacaacaugauggggaagcgggagaagaagcucggcgaguucgggaaggcgaagggcagccgcgccaucugguacauguggcugggcgcccgguaccuggaguucgaggcccucggguuccugaacgaggaccacugguucucccgcgagaacagcuacuccggcguggagggggagggccugcacaagcucggguacauccugcgggacaucagcaagauccccggcggcgccauguacgcggacgacaccgccgggugggacacccgcaucaccgaggacgaccugcacaacgaggagaagaucacgcagcagauggacccggagcaccggcagcucgccaacgccaucuucaagcugaccuaccagaacaaggucgugaaggugcagcgccccacccccaagggcaccgucauggacaucaucucccggaaggaccagcgcgggagcggccaggugggcacguacgggcugaacaccuucaccaacauggaggcccagcucauccggcagauggagggcgagggggugcuguccaaggcggaccuggagaacccccaccuccuggagaagaaggucacccaguggcuggagaccaagggcguggagcgccucaagcggauggccaucagcggggacgacugcguggucaagccgaucgacgaccgcuucgccaacgcccugcuggcccucaacgacaugggcaaggugcggaaggacaucccccaguggcagcccuccaagggcuggcacgacuggcagcagguccccuucugcagccaccacuuccacgagcugaucaugaaggacgggcgcaagcuggucgugccgugccggccccaggacgagcucaucggccgcgcgcggaucucccagggggccggcuggagccugcgcgagacggccugccuggggaaggccuacgcgcagaugugggcccucauguacuuccaccgccgggaccugcgccuggccuccaacgccaucugcagcgccgugcccguccacugggugcccaccucccggaccaccuggagcauccacgcgcaccaccaguggaugacgaccgaggacaugcucaccguguggaaccgcgucuggaucgaggacaacccguggauggaggacaagacccccgugacgaccugggaggacgugcccuaccugggcaagcgggaggaccaguggugcggcagccugaucgggcucaccucccgcgccaccugggcccagaacauccugacggccauccagcagguccggagccugaucggcaacgaggaguuccucgacuacaugcccuccaugaagcgcuuccggaaggaggaggagagcgagggggccaucugguga

SEQ ID NO: 10414 - RNA, 9873 nt, Artificial Sequence
  derived and/or modified CDS sequence (opt1) from DENV-3__AY744685__SS-prME
accagccugugccucaugaugaugcugcccgccacccuggccuuccaccucacgucccgcgacggcgagccgcggaugaucguggggaagaacgagcgcggcaagagccugcuguucaagaccgcguccgggaucaacaugugcacccucaucgccauggaccugggcgagaugugcgacgacaccgucacguacaagugcccccugaucaccgagguggagcccgaggacaucgacugcuggugcaaccucaccagcaccugggugacguacgggaccugcaaccaggccggcgagcaccggcgcgacaagcgguccgucgcccuggccccccacgugggcauggggcuggacacccgcacccagacguggaugagcgcggagggcgccuggcggcagguggagaaggucgagaccugggccuuccgccacccgggguucaccauccucgcccuguuccuggcgcacuacaucggcaccucccucacgcagaagguggugaucuucauccugcugaugcucgucacccccagcaugaccaugcggugcgugggggugggcaaccgcgacuucgucgagggccuguccggggccaccuggguggacgugguccuggagcacggcgggugcgugacgaccauggccaagaacaagcccacccucgacaucgagcugcagaagaccgaggccacgcagcuggccacccuccggaagcugugcaucgagggcaagaucaccaacgugaccacggacagccgcugccccacccagggcgaggcgauccugccggaggagcaggaccagaacuacgucugcaagcacaccuacguggaccggggguggggcaacgggugcggccucuucgggaagggcucccuggugaccugcgccaaguuccagugccuggagagcaucgagggcaaggccguccagcacgagaaccucaaguacacggugaucaucaccgugcacaccggggaccagcaccaggucggcaacgagaugcagggggugaccgccgagaucacgccccaggccuccaccgucgaggcgauccugcccgaguacggcacccuggggcucgagugcagcccccgcaccggccuggacuucaacgagaugauccugcucaccaugaagaacaaggccuggauggugcaccggcagugguucuucgaccugccgcugcccuggacguccggcgccaccaccgagacccccacguggaacaagaaggagcuccuggugaccuucaagaacgcccacgccaagaagcaggaggucguggugcuggggagccaggagggcgcgaugcacaccgcccucaccggggccacggagauccagaccuccggcgggaccagcaucuucgccggccaccugaagugccgccugaagauggacaagcucgagcugaagggcauguccuacgccaugugccugaacgcguucguccucaagaaggaggugagcgagacccagcacgggacgauccugaucaagguggaguacaagggcgaggacgcccccugcaagaucccguucagcaccgaggacgggcagggcaaggcccacaacggccggcugaucaccgccaaccccaucgucaccaagaaggaggagcccgugaacaucgaggcggagcccccguucggggaguccaacaucgugaucggcaucggggacaaggcccugaagaucaacugguacaagaagggcagcuccaucgggaagauguucgaggccacggcccgcggcgcccggcgcauggcgauccucggcgacaccgccugggacuucgggagcgucggcggggugcugaacucccugggcaagauggugcaccagaucuucgggagcgccuacaccgcccucuucuccggcgucagcuggaucaugaagaucggcaucggggugcugcugaccuggaucggccucaacuccaagaacgccagcauguccuucagcugcaucgugaucgggaucaucacgcuguaccugggcgcggucgugcaggccgacauggggugcgugaucaacuggaagggcaaggagcucaagugcggcuccgggaucuucgucaccaacgaggugcacaccuggaccgagcaguacaaguuccaggccgacagccccaagcggcuggccacggccaucgcgggcgccugggagaacggggugugcggcauccgcuccaccacccgcauggagaaccugcucuggaagcagaucgccaacgagcugaacuacauccugugggagaacaacaucaagcucaccaucgucgugggggacgugaucggcguccuggagcagggcaagcggacgcugaccccccagcccauggagcucaaguacagcuggaagaccugggggaaggccaagaucgugaccgcggagacgcagaacuccagcuucaucaucgacggcccgaacacccccgagugccccuccgcccugcgcgccuggaacgugugggaggucgaggacuacggguucggcguguucaccaccaacaucuggcugaagcuccgggagaaguacacgcagcugugcgaccaccgccugaugagcgccgccgugaaggacgagcgggcgguccacgccgacaugggcuacuggaucgagagccagaagaacggguccuggaagcucgagaaggccagccugaucgaggugaagaccugcaccuggcccaagucccacacccuguggagcaacggcgugcucgaguccgacaugaucaucccgaagagccuggccgggcccaucucccagcacaacuaccgccccggcuaccacacccagacggccgggccguggcaccugggcaagcucgagcuggacuucaacuacugcgagggcaccaccgucgugaucaccgagaacugcgggauccggggccccagccugcgcacgaccaccguguccgggaagcucauccacgaguggugcugccggagcugcacccugcccccccugcgcuacaugggcgaggacgggugcugguacggcauggagauccggccgaucaacgagaaggaggagaacauggucaagucccucgugagcgcgggcuccgggaagacggacaacuucaccaugggcgugcugugccuggccauccucuucgaggaggucaugcgcgggaaguucggcaagaagcacaugaucgccggggcccuguucaccuucgugcugcuccugagcggccagaucaccuggcgggacauggcccacacgcugaucaugaucggcuccaacgcgagcgaccgcauggggaugggcgugaccuaccucgcccugaucgccaccuucaagauccagcccuuccuggcccucggguucuuccugcggaagcugaccucccgcgagaaccuccugcugggcgucggccucgcgauggccacgacccugcagcugcccgaggacaucgagcagauggccaacgggaucgcccucggccugauggcccugaagcucaucacccaguucgagaccuaccagcuguggacggcgcugaucagccucaugugcagcaacaccaucuucacccugaccguggccuggcggacggccacccugauccucgccgugaucucccugcugcccgucugccagagcuccagcaugcgcaagaccgacuggcucccgaugaccguggccgcgaugggggugcccccccugccccuguucaucuucucccucaaggacacgcugaagcggcgcagcuggccgcugaacgagggcgucauggccguggggcucgucuccauccuggccagcuccuuccugcgcaacgacgugcccauggccggcccccucguggccggcgggcugcugaucgcgugcuacgucaucaccggcaccagcgccgaccucaccguggagaaggccgccgacgugacgugggaggaggaggccgagcagaccggggucucccacaaccugaugaucaccguggacgacgacggcaccaugcggaucaaggacgacgagacggagaacauccugaccgugcuccugaagaccgcgcugcucaucgucagcgggaucuuccccuacuccaucccggccacccugcugguguggcacaccuggcagaagcagacgcagcgcagcggcgugcucugggacguccccuccccccccgagacccagaaggccgagcuggaggagggcguguaccggaucaagcagcaggggaucuucggcaagacccaggugggggucggcgugcagaaggaggggguguuccacaccauguggcacgucacgcgcggcgccgugcugacccacaacggcaagcggcucgagccgaacugggcgaacgugaagaaggaccugaucagcuacgggggcggguggaagcuguccgcccaguggcagaagggcgaggagguccaggugaucgccguggagcccgggaagaaccccaagaacuuccagaccaugcccggcaucuuccagaccacgaccggcgagaucggggccaucgcccuggacuucaagccgggcaccagcgggucccccaucaucaaccgcgagggcaaggucgugggccucuacgggaacggcguggucaccaagaacgggggcuacgugagcgggaucgcgcagacgaacgccgagcccgacggcccgacccccgagcuggaggaggagauguucaagaagcggaaccugaccaucauggaccuccaccccggcagcgggaagacccgcaaguaccugcccgccaucgugcgggaggccaucaagcgccggcugcgcacgcucauccuggccccgacccgggucguggcggccgagauggaggaggcccugaagggccuccccauccgcuaccagaccaccgccacgaaguccgagcacaccgggcgggagaucguggaccugaugugccacgccaccuucaccaugcgccugcucagccccguccgggugcccaacuacaaccugaucgugauggacgaggcgcacuucacggacccggccuccaucgccgcccgcggcuacaucagcacccgggucgggaugggcgaggcggccgccaucuucaugaccgccaccccccccggcacggccgacgcguucccccaguccaacgccccgauccaggacgaggagcgcgacauccccgagcggagcuggaacuccgggaacgaguggaucaccgacuucgccggcaagaccgugugguucgugcccagcaucaaggccgggaacgacaucgccaacugccugcgcaagaacggcaagaaggucauccagcucucccgcaagaccuucgacacggaguaccagaagaccaagcugaacgacugggacuucguggugaccaccgacaucagcgagaugggggcgaacuucaaggccgaccgggucaucgacccccgccggugccugaagccggugauccucacggacggccccgagcgcgugauccuggccggccccaugcccgucaccguggccuccgccgcgcagcggcgcgggcgggugggccgcaacagccagaaggagaacgaccaguacaucuucaccgggcagccgcugaacaacgacgaggaccacgcccacuggaccgaggccaagaugcuccuggacaacaucaacacgcccgagggcaucauccccgcccuguucgagcccgagcgggagaaguccgcggccaucgacggggaguaccgccucaagggcgagagccggaagaccuucgucgagcugaugcgccggggcgaccugccgguguggcucgcccacaagguggccuccgaggggaucaaguacaccgaccgcaaguggugcuucgacggcgagcggaacaaccagauccuggaggagaacauggacgucgagaucuggaccaaggagggggagaagaagaagcugcgcccccgguggcucgacgcccgcaccuacagcgacccccuggcgcugaaggaguucaaggacuucgccgccggccggaaguccaucgcccucgaccuggugacggagaucggccgcguccccagccaccuggcccaccgcacccggaacgcgcucgacaaccuggugaugcugcacaccuccgagcacgggggccgcgccuaccggcacgccguggaggagcucccggagaccauggagacgcugcugcuccuggggcugaugauccuccugaccggcggggccaugcuguuccucaucagcggcaagggcaucgggaagaccagcaucggccugaucugcgucguggccuccagcgggaugcuguggauggcggacgugccccuccaguggaucgccuccgccaucguccuggaguucuucaugauggugcugcucauccccgagccggagaagcagcgcaccccccaggacaaccagcuggccuacguggucaucggcauccugacgcucgccgcgaucguggccgccaacgagauggggcugcuggagaccaccaagcgggaccucggcaugagcaaggagcccggcguggucucccccaccagcuaccuggacguggaccugcacccggccuccgcguggacgcucuacgccguggccaccaccgucaucacccccaugcugcgccacacgaucgagaacagcaccgccaacgugucccuggccgcgaucgccaaccaggccgugguccucauggggcuggacaagggcuggcccaucagcaagauggaccugggggugccccuccuggcccugggcugcuacucccaggugaacccgcucacccugaccgccgcgguccugcuccuggugacgcacuacgccaucaucgggcccggccugcaggccaaggccacccgggaggcccagaagcgcaccgcggccggcaucaugaagaaccccaccguggacgggaucaugacgaucgaccucgaccccgucaucuacgacagcaaguucgagaagcagcugggccaggugaugcugcucgugcugugcgccguccagcugcuccugaugcggaccuccugggccuucugcgaggcgcugacccucgccaccgggccgaucacgacccugugggagggcagccccggcaaguucuggaacaccaccaucgccguguccauggccaacaucuuccgcgggagcuaccuggccggcgcggggcucgccuucuccaucaugaagagcgugggcacggggaagcggggcaccggcucccagggggagacccugggcgagaaguggaagaagaagcugaaccagcucagccgcaaggaguucgaccuguacaagaagagcgggaucaccgaggucgaccggacggaggccaaggagggccugaagcgcggggagaucacccaccacgccgugucccggggcagcgccaagcuccagugguucguggagcgcaacauggucauccccgagggccgggugaucgaccuggggugcggccgcgggggcugguccuacuacugcgcggggcugaagaaggugaccgagguccggggcuacaccaagggcgggcccggccacgaggagccggugcccaugagcaccuacggguggaacaucgugaagcucauguccggcaaggacgucuucuaccugccccccgagaagugcgacacgcugcugugcgacaucggggagagcuccccgagccccaccguggaggagucccgcaccauccgggugcucaagauggucgagcccuggcugaagaacaaccaguucugcaucaaggugcugaaccccuacaugccgaccgugaucgagcaccucgagcgccugcagcgcaagcacggcggcaugcugguccggaacccccucagccgcaacuccacgcacgagauguacuggaucagcaacgggaccggcaacaucguguccagcgugaacauggucucccggcugcugcucaaccgcuucaccaugacccaccggcgccccacgaucgagaaggacguggaccugggggccggcacccggcacgugaacgccgagcccgagaccccgaacauggacgucaucggcgagcgcauccggcgcaucaaggaggagcacagcuccaccuggcacuacgacgacgagaaccccuacaagacgugggccuaccacgggagcuacgaggugaaggccaccggcuccgcgagcagcaugaucaacggggucgugaagcugcucaccaagcccugggacguggucccgauggugacccagauggccaugacggacaccacccccuucggccagcagcggguguucaaggagaaggucgacacccgcacgccccggcccaugccggggacccgcaaggugauggagaucaccgccgaguggcuguggcggacccugggccgcaacaagcggccccgccucugcacgcgggaggaguucaucaagaaggugcgcaccaacgccgcgaugggcgccgucuucaccgaggagaaccagugggacuccgcccgcgccgccguggaggacgaggaguucuggaagcugguggaccgggagcgcgagcugcacaagcucgggaagugcggcagcugcgucuacaacaugauggggaagcgggagaagaagcugggcgaguucgggaaggcgaagggcucccgcgccaucugguacauguggcugggcgcccgguaccucgaguucgaggcccugggguuccugaacgaggaccacugguucagccgcgagaacucccacagcggcguggagggggagggccuccacaagcugggguacauccugcgggacaucuccaagauccccggcggcgccauguacgcggacgacaccgccgggugggacacgcgcaucaccgaggacgaccuccacaacgaggagaagaucacccagcagauggaccccgagcaccggcagcuggccaacgccaucuucaagcugaccuaccagaacaagguggucaaggugcagcgcccgacgcccaagggcaccgugauggacaucaucagccggaaggaccagcgcggguccggccaggucggcaccuacgggcucaacaccuucacgaacauggaggcccagcugauccggcagauggagggcgagggggugcugagcaaggcggaccucgagaacccccaccugcuggagaagaaggugacccaguggcucgagaccaagggcgucgagcgccugaagcggauggccaucuccggggacgacugcguggugaagcccaucgacgaccgcuucgccaacgcccugcucgcccugaacgacaugggcaagguccggaaggacaucccgcaguggcagcccagcaagggcuggcacgacuggcagcaggugcccuucugcucccaccacuuccacgagcugaucaugaaggacgggcgcaagcucgugguccccugccggccgcaggacgagcugaucggccgcgcgcggaucagccagggggccggcuggucccugcgcgagaccgccugccucgggaaggccuacgcgcagaugugggcccugauguacuuccaccgccgggaccugcgccucgccagcaacgccaucugcuccgccgugcccgugcacuggguccccaccagccggacgaccugguccauccacgcgcaccaccaguggaugaccaccgaggacaugcugacgguguggaaccgcguguggaucgaggacaaccccuggauggaggacaagaccccggucaccaccugggaggacgugcccuaccugggcaagcgggaggaccaguggugcggcagccucaucgggcugacgagccgcgccaccugggcccagaacauccugaccgccauccagcaggugcggucccucaucggcaacgaggaguuccuggacuacaugcccagcaugaagcgcuuccggaaggaggaggaguccgagggggccaucugguga

SEQ ID NO: 10415 - RNA, 9873 nt, Artificial Sequence
  derived and/or modified CDS sequence (opt1) from DENV-3__AY876494__SS-prME
accagccucugccucaugaugaugcugcccgcgacccuggccuuccaccucaccagccgcgacggggagccccggaugaucguggcgaagaacgagcgcgggaagucccugcuguucaagaccgccagcggcaucaacaugugcacccucaucgccauggaccugggggagaugugcgacgacaccgugaccuacaagugcccccugaucgccgagguggagcccgaggacaucgacugcuggugcaaccucaccagcaccugggugaccuacgggaccugcaaccaggccggggagcaccggcgcgacaagcgguccgucgcgcuggcgccccacgugggcaugggccuggacacccgcacccagaccuggaugagcgccgagggggccuggcggcccguggagaagguggagacgugggcgcuccgccaccccggcuucaccauccuggcccuguuccucgcccacuacaucgggaccucccugacccagaagguggugaucuucauccugcucaugcuggucacgcccagcaugaccaugcggugcgugggcguggggaaccgcgacuucgucgagggccuguccggcgccaccuggguggacgugguccucgagcacgggggcugcgugaccacgauggccaagaacaagcccacccuggacaucgagcugcagaagaccgaggcgacccagcucgccacgcugcggaagcugugcaucgaggggaagaucaccaacgugaccaccgacagccgcugcccgacgcagggcgaggccauccuccccgaggagcaggaccagaacuacgucugcaagcacaccuacguggaccggggcugggggaacggcugcgggcuguucggcaaggggucccuggugaccugcgccaaguuccagugccucgagcccaucgagggcaaggucgugcagcacgagaaccugaaguacaccgugaucaucacgguccacaccggcgaccagcaccagguggggaacgacacccagggcgucaccguggagaucacgccccaggccagcaccgcggaggccauccugccggaguacgggacccucgugcuggagugcagcccccgcaccggccuggacuucaacgagaugauccuccugaccaugaagaacaaggccuggaugguccaccggcagugguucuucgaccugccccuccccuggacgagcggggccaccaccgagaccccgacguggaaccgcaaggagcugcuggugaccuucaagaacgcccacgcgaagaagcaggagguggucgugcucggcucccaggagggcgccaugcacaccgcccugaccggggccacggagauccagaacagcggcgggaccuccaucuucgccggccaccugaagugccggcucaagauggacaagcuggagcugaaggggaugagcuacgcgaugugccucaacaccuucgugcugaagaaggaggucuccgagacccagcacggcacgauccugaucaagguggaguacaagggcgaggacgcccccugcaagauccccuucagcaccgaggacgggcagggcaaggcccacaacgggcgccugaucaccgccaaccccguggucaccaagaaggaggagccggugaacaucgaggcggagccgcccuucggcgagagcaacaucgugaucggcaucggggacaaggcccucaagaucaacugguacaagaagggcuccagcaucgggaagauguucgaggccacggcccggggcgcccgccggauggcgauccugggggacaccgccugggacuucggcuccgucggcggggugcugaacagccucggcaagauggugcaccagaucuucggguccgccuacaccgcccuguucagcggcgucuccuggaucaugaagaucgggaucggcgugcugcucaccuggaucggccugaacagcaagaacacguccaugagcuucuccugcaucgugaucgggaucaucacccuguaccucggcgccgucgugcaggcggacauggggugcgugaucaacuggaagggcaaggagcugaagugcgggagcggcaucuucgucaccaacgaggugcacaccuggacggagcaguacaaguuccaggccgacucccccaagcgccuggccaccgccaucgccggcgcgugggagaacggggugugcggcauccgcagcaccacccggauggagaaccuccuguggaagcagaucgccaacgagcugaacuacauccucugggagaacaacaucaagcugacggucguggugggggacaucaucggcguccuggagcaggggaagcgcacccucaccccgcagcccauggagcugaaguacuccuggaagaccuggggcaaggccaagaucgugacggccgagacccagaacagcuccuucaucaucgacggccccaacacccccgagugcccgagcgcgucccgggccuggaacgugugggaggucgaggacuacggguucggcguguucaccacgaacaucuggcugaagcuccgcgagguguacacccagagcugcgaccaccggcugaugagcgccgccaucaaggacgagcgcgccguccacgcggacaugggguacuggaucgagucccagaagaacggcagcuggaagcuggagaaggccuccuucaucgaggugaagaccugcaccuggcccaagagccacacccucugguccaacggcgugcuggagagcgacaugaucauccccaagucccuggccgggccgaucagccagcacaaccaccggcccggcuacuacacgcagaccgccgggcccuggcaccucggcaagcuggagcuggacuucaacuacugcgaggggaccaccgucgugaucacggagaacugcggcacccgcggccccucccuccggaccaccacggugagcgggaagcugauccacgaguggugcugccgcuccugcacccugccgccccuccgguacaugggcgaggacgggugcugguacggcauggagauccgccccaucaacgagaaggaggagaacauggucaagagccugguguccgccgggagcggcaagguggacaacuucaccaugggcguccugugccucgcgauccuguucgaggaggugaugcgggggaaguucggcaagaagcacaugaucgccggggugcuguucaccuucguccuccugcuguccggccagaucacguggcgcgacauggcccacacccucaucaugaucgggagcaacgccuccgaccggaccggcaugggcgugaccuaccuggcccugaucgcgacguucaagauccagcccuuccucgcccugggguucuuccugcgcaagcucaccagccgggagaaccugcugcucggcguggggcuggccauggccaccacccugcagcucccggaggacaucgagcagauggcgaacggcaucgcccugggccugaugacgcucaagcugaucacccaguucgagaccuaccagcuguggaccgcccucgucagccugacgugcuccaacaccaucuucacccugaccguggccuggcgcacggccacccucauccuggcgggggucagccugcucccccugugccaguccagcuccaugcggaagaccgacuggcugcccaugaccguggccgccaugggcgugcccccgcucccccuguucaucuucagccugaaggacacgcccaagcgccgcuccuggccccucaacgagggggucauggccgugggccuggugagcauccuggccuccagccuccugcggaacgacgucccgauggcggggccccugguggccggcggccuccugaucgccugcuacgugaucaccgggaccuccgccgaccugaccgucgagaaggccgcggacgugacgugggaggaggaggccgagcagaccggcgugagccacaaccucaugaucaccgucgacgacgacgggaccaugcgcaucaaggacgacgagaccgagaacauccccacggugcugcugaagaccgcccuccugaucguguccggcaucuuccccuacagcaucccggccacccugcucgucuggcacaccuggcagaagcagacgcagcgguccggggugcugugggacgugcccuccccgcccgagacccagaaggccgagcuggaggagggcgucuaccgcaucaagcagcagggcaucuucgggaagacccaggugggcguggggguccagaaggagggcguguuccacaccauguggcacgugacgcggggcgccguccucacccacaacggcaagcgccuggagccgaacugggccuccgugaagaaggaccugaucagcuacggcgggggcuggcggcucuccgcccaguggcagaagggggaggaggugcaggucaucgccguggagcccggcaagaaccccaagaacuuccagaccaugccggggaucuuccagaccacgaccggcgagaucggcgcgaucgcccuggacuucaagcccgggaccagcggcagccccaucaucaaccgcgaggggaagguggucggccuguacggcaacgggguggugaccaagaacggcggguacgucuccggcaucgcccagacgaacgccgagcccgacgggccgacccccgagcuggaggaggagauguucaagaagcggaaccucaccaucauggaccugcaccccggcagcggcaagacccgcaaguaccugcccgccaucgugcgggaggcgaucaagcgccggcuccgcacgcugauccuggccccgacccggguggucgccgccgagauggaggaggcccucaaggggcugcccauccgcuaccagaccaccgcgacgaaguccgagcacaccggccgggagaucguggaccugaugugccacgccaccuucaccaugcgccuccugagccccgugcggguccccaacuacaaccugaucaucauggacgaggcccacuucacggacccggccuccaucgccgcgcgcggguacaucagcacccgggugggcaugggggaggccgccgccaucuucaugaccgcgacgccgcccggcacggccgaggccuucccccaguccaacgccccgauccaggacgaggagcgcgacauccccgagcgcagcuggaacuccggcaacgaguggaucaccgacuucguggggaagaccgucugguucgugcccagcaucaaggccggcaacgacaucgcgaacugccuccggaagaacgggaagaaggugauccagcugucccgcaagaccuucgacacggaguaccagaagacccggcugaacgacugggacuucgucgugaccaccgacaucagcgagaugggcgccaacuucaaggccgaccgcgugaucgacccccggcgcugccucaagccggucauccugacggacgggcccgagcgggugauccuggccggccccaugcccgugaccgccgcguccgccgcccagcgccggggccgcgucgggcggaacccgcagaaggagaacgaccaguacaucuucaccggccagccccucaacaacgacgaggaccacgcccacuggaccgaggccaagaugcugcuggacaacaucaacacccccgaggggaucauccccgcccucuucgagccggagcgcgagaaguccgccgccaucgacggcgaguaccggcugaagggggagucccgcaagacguucguggagcugaugcggcgcggcgaccuccccgucuggcuggcccacaagguggcgagcgagggcaucaaguacaccgaccggaaguggugcuucgacggggagcgcaacaaccagauccuggaggagaacauggacguggagaucuggaccaaggagggcgagcggaagaagcuccgcccccgcuggcuggacgcccggaccuacuccgacccgcuggcccucaaggaguucaaggacuucgccgccgggcgcaagagcaucgcgcuggaccuggucacggagaucggccgggugcccucccaccucgcccaccgcacccggaacgcccuggacaaccuggugaugcuccacaccagcgagcacggcgggcgcgccuaccggcacgccgucgaggagcugcccgagaccauggagacgcugcuccugcugggccucaugauccugcugaccgggggcgcgaugcuguuccugaucagcgggaagggcaucggcaagaccuccaucgggcugaucugcgugaucgugagcuccggcaugcucuggauggccgacgucccccugcaguggaucgccagcgccaucgugcuggaguucuucaugauggugcuccugaucccggagcccgagaagcagcgcacgccccaggacaaccagcuggccuacgucgugaucgggauccucacgcuggcggccaucguggccgccaacgagaugggccugcucgagaccaccaagcgggaccuggggauguccaaggagcccggcgucgugagcccgaccuccuaccuggacguggaccuccaccccgccagcgcguggacgcuguacgccgucgccaccaccgugaucacccccaugcugcgccacacgaucgagaacuccaccgccaacgugagccucgcggccaucgccaaccaggccgucgugcugaugggccuggacaagggguggcccaucuccaagauggaccucggcgugccgcugcuggcccucgggugcuacagccaggucaacccccugacccugaccgcggccgugcuccugcuggugacgcacuacgccaucaucggccccgggcuccaggccaaggccacccgggaggcgcagaagcgcaccgccgccggcaucaugaagaaccccaccgucgacggcaucaugacgaucgaccuggacccggugaucuacgacuccaaguucgagaagcagcugggccaggugaugcuccugguccugugcgccgugcagcuccugcugaugcggaccagcugggcccucugcgaggcgcugacccuggccaccggccccaucacgacccucugggaggggucccccggcaaguucuggaacaccaccaucgccgugagcauggccaacaucuuccgcggcuccuaccuggcgggggccggccuggccuucagcaucaugaaguccgucgggacgggcaagcgggggaccggcagccagggcgagacccucggggagaaguggaagaagaagcugaaccagcugagccgcaaggaguucgaccucuacaagaaguccggcaucaccgagguggaccggaccgaggccaaggaggggcugaagcgcggcgagacgacccaccacgccgugagccggggguccgcgaagcugcagugguucgucgagcgcaacauggugauccccgagggccgggugaucgaccucggcugcgggcgcggcggguggagcuacuacugcgccggccugaagaaggucaccgaggugcgcggguacaccaagggcggcccggggcacgaggagcccgugcccauguccacguacggcuggaacaucgucaagcugaugagcgggaaggacguguucuaccucccgcccgagaagugcgacacccugcugugcgacaucggcgaguccagccccucccccaccguggaggagagccggaccauccgcguccugaagaugguggagcccuggcucaagaacaaccaguucugcaucaaggugcugaaccccuacaugcccacggucaucgagcaccuggagcggcuccagcgcaaguacgggggcaugcuggugcggaacccccugucccgcaacagcacccacgagauguacuggaucuccaacggcaccgggaacaucgugagcuccgucaacauggugagccggcuccugcugaaccgcuucaccaugacgcaccggcgcccgaccaucgagaaggacgucgaccucggcgccgggacccggcacgugaacgccgagcccgagacccccaacauggacgugaucggcgagcgcaucaagcggaucaaggaggagcacuccagcacguggcacuacgacgacgagaaccccuacaagaccugggccuaccacggcuccuacgaggucaaggcgaccgggagcgccagcuccaugaucaacggcguggugaagcugcugaccaagccgugggacgucgugcccauggugacgcagauggccaugaccgacaccacccccuucgggcagcagcgcgucuucaaggagaagguggacacgcggacgccccgcccgaugcccggcacccggaaggugauggagaucaccgccgaguggcucuggcgcacgcuggggcggaacaagcgcccccgccugugcacccgggaggaguucaccaagaagguccgcaccaacgccgcgaugggcgccguguucacggaggagaaccagugggacagcgcccgggccgcgguggaggacgaggaguucuggaaccucugggaccgcgagcgggagcugcacaagcugggcaagugcggguccugcgucuacaacaugaugggcaagcgcgagaagaagcucggggaguucggcaaggccaaggggagccgggccaucugguacauguggcugggcgcccgcuaccuggaguucgaggcccucggcuuccugaacgaggaccacugguucucccgggagaacagcuacuccgggguggagggcgaggggcugcacaagcucggcuacauccugcgcgacaucagcaagauccccgggggcgcgauguacgccgacgacaccgccggcugggacacccggaucaccgaggacgaccugcacaacgaggagaagaucacgcagcagauggacccggagcaccgccagcucgccaacgccaucuucaagcugaccuaccagaacaagguggucaaggugcagcggcccacccccaaggggaccgugauggacaucaucucccgcaaggaccagcggggcagcgggcaggucggcaccuacggccugaacacguucaccaacauggaggcgcagcucgugcgccagauggagggggagggcgugcuguccaaggccgaccuggagaacccccaccuccuggagaagaagaucaccccguggcuggagcccaagggggucgagcggcucaagcgcauggccaucagcggcgacgacugcguggugaagcccaucgacgaccgguucgccaacgcccugcuggcgcucaacgacauggggaagguccgcaaggacaucccccaguggcagccguccaagggcuggcacgacuggcagcagguccccuucugcagccaccacuuccacgagcugaucaugaaggacggccggaagcuggugguccccugccgcccccaggacgagcucaucgggcgcgcccggaucucccagggcgccggguggagccugaaggagaccgccugccugggcaaggccuacgcgcagauguggucccucauguacuuccaccgccgggaccugcgccuggccagcaacgccaucugcuccgccgugccggugcacuggguccccacgagccggaccaccuggagcauccacgcgcaccaccaguggaugaccacggaggacaugcucaccguguggaaccgcguguggaucgaggacaaccccuggauggaggacaagaccccggucaccacgugggaggacgugcccuaccuggggaagcgggaggaccaguggugcggcucccugaucggccucaccagccgcuccaccugggcccagaacauccugaccgccauccagcagguccggagccugaucggggacgaggaguuccucgacuacaugcccuccaugaagcgcuuccggaaggaggaggagagcgagggcgccaucugguga

SEQ ID NO: 10416 - RNA, 9873 nt, Artificial Sequence
  derived and/or modified CDS sequence (opt1) from DENV-3__AY923865__SS-prME
accagccucugccucaugaugaugcugcccgccacccuggccuuccaccucaccagccgggacggcgagccgcggaugaucguggggaagaacgagcggggcaagagccugcuguucaagaccgcguccgggaucaacaugugcacccucaucgccauggaccugggcgagaugugcgacgacaccgugaccuacaagugcccccugaucgccgagguggagcccgaggacaucgacugcuggugcaaccucaccagcaccugggugaccuacgggaccugcaaccaggccggcgagcaccggcgcgacaagcgguccguggcccuggcgccccacgugggcauggggcuggacacccgcacccagaccuggaugagcgccgagggcgccuggcgccagguggagaagguggagacgugggcccuccgccacccgggguucaccauccuggcgcuguuccucgcccacuacaucggcaccucccugacccagaagguggugaucuucauccugcucaugcuggucacgcccagcaugaccaugcggugcgugggggugggcaaccgcgacuucgucgagggccuguccggggccaccuggguggacgugguccucgagcacggcgggugcgugaccacgauggccaagaacaagcccacccuggacaucgagcugcagaagaccgaggccacccagcucgcgacgcugcggaagcugugcaucgagggcaagaucaccaacaucaccaccggcagccgcugccccacgcagggggaggccauccucccggaggagcaggaccagaacuacgugugcaagcacaccuacgucgaccggggcugggggaacggcugcgggcuguucggcaagggcucccuggugaccugcgccaaguuccagugccucgagcccaucgaggggaaggugguccaguacgagaaccugaaguacaccgugaucaucacggugcacaccggcgaccagccccaggucgggaacgacacccagggcgugaccgucgagaucacgccccaggccagcaccguggaggccgugcugcucgaguacgggacccugggccugaagugcuccccgcgcaccggccucgacuucaacgagaugauccugcugaccaugaagacgaaggcguggaugguccaccggcagugguucuucgaccucccccugcccuggaccagcggggccaccaccgagacgcccaccuggaaccgcaaggagcugcucgugaccuucaagaacgcccacgccaagaagcaggagguggucgugcugggcucccaggagggggccaugcacaccgcgcugacgggcgccaccgagauccagaacagcgggggcaccuccaucuucgccggccaccucaagugccggcugaagauggacaagcuggagcucaaggggaugagcuacgccaugugccugaacaccuucgugcugaagaaggaggucuccgagacgcagcacggcaccauccugaucaagguggaguacaagggggaggacgccccgugcaagauccccuucagcaccgaggacggccagggcaaggcgcacaacgggcgccucaucaccgccaaccccguggucacgaagaaggaggagcccgugaacaucgaggccgagccgcccuucggcgagagcaacaucgugaucgggaucggcgacaaggcccugaagaucaacugguacaagaagggguccagcaucggcaagauguucgaggcgaccgcccggggcgcccgccggauggccauccugggggacaccgccugggacuucggcuccgucgggggcgugcucaacagccuggggaagauggugcaccagaucuucggcuccgcguacaccgcccuguucagcggcgucuccuggaucaugaagaucgggaucggcgugcuccugacguggaucgggcugaacagcaagaacaccuccaugagcuucuccugcaucgugaucggcaucaucacccucuaccugggggccgucgugcaggccgacaugggcugcgugaucaacuggaagggcaaggagcugaagugcgggagcggcaucuucgucaccaacgaggugcacacguggaccgagcaguacaaguuccaggccgacucccccaagcgccucgcgaccgccaucgccggggccugggagaacggcgugugcgggauccgcagcaccacgcggauggagaaccugcuguggaagcagaucgccaacgagcucaacuacauccugugggagaacaacaucaagcugaccgucguggugggcgacaucaucggcguccucgagcaggggaagcgcacccugacgccccagccgauggagcugaaguacuccuggaagacguggggcaaggcgaagaucgugaccgccgagacccagaacagcuccuucaucaucgacgggcccaacacccccgagugccccagcgccucccgggccuggaacgugugggaggucgaggacuacggcuucggcguguucacgaccaacaucuggcucaagcugcgcgagguguacacccagagcugcgaccaccggcugaugagcgcggccaucaaggacgagcgcgccguccacgccgacaugggguacuggaucgagucccagaagaacggcagcuggaagcucgagaaggccuccuucaucgaggugaagaccugcaccuggcccaagagccacacgcugugguccaacggggugcuggagagcgacaugaucauccccaagucccucgcgggccccaucagccagcacaaccaccggccgggguaccacacccagaccgccggccccuggcaccugggcaagcuggagcucgacuucaacuacugcgaggggaccacggucgugaucaccgagaacugcggcacccgcgggcccucccugcggaccacgaccgugagcggcaagcugauccacgaguggugcugccgcuccugcacccugccgccccugcgguacaugggggaggacggcugcugguacggcauggagauccgccccaucaacgagaaggaggagaacauggucaagagccugguguccgccgggagcggcaagguggacaacuucaccauggggguccucugccuggccauccuguucgaggaggugaugcggggcaaguucgggaagaagcacaugaucgccggcguccucuucacguucguccugcugcucuccggccagaucaccuggcgcgacauggcgcacacccugaucaugaucgggagcaacgccuccgaccggaugggcaugggggugaccuaccuggcccucaucgccacguucaagauccagcccuuccuggcccugggcuucuuccuccgcaagcugaccagccgggagaaccugcuccugggcguggggcuggcgauggccaccacccuccagcugcccgaggacaucgagcagauggccaacggcaucgcccuggggcucaugacgcugaagcugaucacccaguucgagaccuaccagcucuggaccgcgcuggucagccugacgugcuccaacaccaucuucacccucaccguggccuggcgcacggccacccugauccuggccggcgucagccuccugccccugugccaguccagcuccaugcggaagaccgacuggcuccccaugaccguggccgcgaugggggugccgccccucccgcuguucaucuucagccucaaggacacgcccaagcgccgcuccuggccccugaacgagggcgucauggccgugggccuggugagcauccucgccuccagccugcugcggaacgacguccccauggccgggccgcucguggccggcgggcugcugaucgcgugcuacgugaucaccggcaccuccgccgaccucaccgucgagaaggccgccgacgugacgugggaggaggaggccgagcagaccggggugagccacaaccugaugaucaccgucgacgacgacggcaccaugcgcaucaaggacgacgagaccgagaacauccugacggugcuccugaagaccgcgcugcucaucguguccggcaucuuccccuacagcauccccgccacccugcuggucuggcacaccuggcagaagcagacgcagcgguccggggugcucugggacgugcccagcccgcccgagacccagaaggccgagcuggaggagggcgucuaccgcaucaagcagcaggggaucuucggcaagacccaggugggggugggcguccagaaggagggcguguuccacaccauguggcacgugacgcgcggggccguccugacccacaacggcaagcgccucgagcccaacugggccuccgugaagaaggaccugaucagcuacgggggcggguggcggcuguccgcgcaguggcagaagggcgaggaggugcaggucaucgccguggagcccggcaagaacccgaagaacuuccagaccaugcccgggaucuuccagaccacgaccggcgagaucggggccaucgcccuggacuucaagcccggcaccagcggcagcccgaucaucaaccgcgaggggaagguggucggccucuacgggaacggcguggugaccaagaacgggggcuacgucuccggcaucgcgcagacgaacgccgagcccgacgggcccacccccgagcuggaggaggagauguucaagaagcggaaccugaccaucauggaccuccacccgggcagcgggaagacccgcaaguaccugcccgccaucgugcgggaggccaucaagcgccggcugcgcacgcucauccuggcccccacccggguggucgcggccgagauggaggaggcccugaagggccuccccauccgcuaccagaccaccgccacgaaguccgagcacaccgggcgggagaucguggaccugaugugccacgccaccuucaccaugcgccugcucagcccggugcggguccccaacuacaaccugaucaucauggacgaggcgcacuucacggaccccgccuccaucgccgcccgcggcuacaucagcacccgggugggcaugggggaggccgcggccaucuucaugaccgccacgcccccgggcacggccgaggcguucccccaguccaacgcccccauccaggacgaggagcgcgacauccccgagcgcagcuggaacuccgggaacgaguggaucaccgacuucgugggcaagaccgucugguucgugccgagcaucaaggccgggaacgacaucgccaacugccugcggaagaacggcaagaaggugauccagcucucccgcaagaccuucgacacggaguaccagaagacccggcugaacgacugggacuuccuggucaccaccgacaucagcgagaugggcgccaacuucaaggcggaccgcgugaucgacccccggcgcugccucaagcccgugauccugacggacgggcccgagcgggucauccuggccggcccgaugcccgugaccgccgccuccgccgcgcagcgccgggggcgcgugggccggaacccccagaaggagaacgaccaguacaucuucaccgggcagccccucaacaacgacgaggaccacgcccacuggaccgaggccaagaugcugcuggacaacaucaacaccccggagggcaucauccccgcccucuucgagcccgagcgcgagaaguccgccgcgaucgacggcgaguaccggcugaagggggagucccgcaagacguucgucgagcugaugcggcgcggcgaccuccccguguggcuggcccacaaggucgccagcgaggggaucaaguacaccgaccggaaguggugcuucgacggcgagcgcaacaaccagauccuggaggagaacauggacguggagaucuggaccaaggagggcgagcggaagaagcuccgcccgcgcuggcuggacgcccggaccuacuccgacccccuggcgcucaaggaguucaaggacuucgccgccgggcgcaagagcaucgcccuggaccuggugacggagaucggccggguccccucccaccucgcccaccgcacccggaacgcgcuggacaaccuggugaugcuccacaccagcgagcacgggggccgcgccuaccggcacgccguggaggagcugccggagaccauggagacgcugcuccugcuggggcucaugauccugcugaccggcggcgccaugcuguuccugaucagcgggaagggcaucgggaagaccuccaucggccugaucugcgucaucgugagcuccgggaugcucuggauggccgacgugccccugcaguggaucgcgagcgccaucguccuggaguucuucaugauggugcuccugauccccgagcccgagaagcagcgcaccccgcaggacaaccagcuggccuacguggucaucggcauccucacgcuggccgccaucguggcggccaacgagaugggccugcucgagaccaccaagcgggaccuggggauguccaaggagcccggcguggucagccccaccuccuaccuggacguggaccuccaccccgccagcgccuggacgcuguacgccguggcgaccaccgucaucaccccgaugcugcgccacacgaucgagaacuccaccgccaacgugagccucgccgccaucgcgaaccaggccgugguccugauggggcuggacaagggcuggcccaucuccaagauggaccucggggugccccugcuggcccucggcugcuacagccaggugaacccccugacccugaccgccgccguccuccugcuggugacgcacuacgcgaucaucggcccggggcuccaggccaaggccacccgggaggcccagaagcgcaccgccgcgggcaucaugaagaaccccaccguggacgggaucaugacgaucgaccuggaccccgucaucuacgacuccaaguucgagaagcagcugggccaggugaugcuccuggugcugugcgccguccagcuccugcugaugcggaccagcugggcccucugcgaggcccugacccuggccaccggccccaucacgacccucugggagggguccccgggcaaguucuggaacaccaccaucgcggugagcauggccaacaucuuccgcggguccuaccuggccggcacggggcuggccuucagcaucaugaaguccgugggcaccggccggcgcgggaccggcagccagggggagacccucggcgagaaguggaagaagaagcugaaccagcugagccggaaggaguucgaccucuacaagaaguccgggaucaccgaggucgaccgcacggaggcgaaggagggccugaagcggggcgagaccacccaccacgccgugagccgcggguccgccaagcugcagugguucguggagcggaacauggucauccccgagggccgcgugaucgaccucgggugcggccgcgggggcuggagcuacuacugcgccggccugaagaaggugaccgagguccggggguacacgaagggcgggcccggccacgaggagcccgugccgauguccaccuacggguggaacaucgugaagcugaugagcggcaaggacgucuucuaccugccgcccgagaagugcgacacccuccugugcgacaucggcgaguccagccccuccccgaccguggaggagagccgcacgauccgggugcugaagauggucgagcccuggcucaagaacaaccaguucugcaucaaggugcugaaccccuacaugcccaccgugaucgagcaccuggagcgccuccagcggaaguacgggggcaugcugguccgcaacccgcugucccggaacagcacccacgagauguacuggaucuccaacgggaccggcaacaucgugagcuccgugaacauggucagccgccuccugcugaaccgguucacgaugacccaccgccggcccaccaucgagaaggacguggaccucggcgccgggacccgccacgucaacgcggagcccgagacgccgaacauggacgugaucggcgagcggaucaagcgcaucaaggaggagcacuccagcaccuggcacuacgacgacgagaaccccuacaagaccugggccuaccacggguccuacgaggugaaggccaccggcagcgccagcuccaugaucaacggggucgugaagcugcugacgaagcccugggacgugguccccauggugacccagauggccaugaccgacaccacgccguucggccagcagcggguguucaaggagaaggucgacacccgcacgccccggcccaugcccggcacccgcaaggugauggagaucacggcggaguggcucuggcggacccuggggcgcaacaagaagccgcgccugugcacccgggaggaguucaccaagaaggugcgcacgaacgccgccaugggcgccgucuucaccgaggagaaccagugggacagcgcccgggcggccguggaggacgaggaguucuggaagcucguggaccgcgagcgggagcugcacaagcuggggaagugcggcuccugcgucuacaacaugauggggaagcgcgagaagaagcucggcgaguucggcaaggccaaggggagccgggccaucugguacauguggcugggcgcgcgcuaccuggaguucgaggcccucggguuccugaacgaggaccacugguucucccgggagaacagcuacuccggcguggagggggagggccugcacaagcucggcuacauccugcgcgacaucagcaagauccccgggggcgccauguacgccgacgacaccgccgggugggacacccggaucacggaggacgaccugcacaacgaggagaagaucacccagcagauggaccccgagcaccgccagcucgcgaacgccaucuucaagcugaccuaccagaacaagguggucaaggugcagcggcccaccccgaagggcaccgugauggacaucaucucccgcaaggaccagcggggcagcgggcaggucggcacguacgggcugaacaccuucaccaacauggaggcccagcucgugcgccagauggagggcgagggggugcuguccaaggccgaccuggagaacccccaccuccuggagaagaagaucacccaguggcuggagacgaagggcgucgagcggcucaagcgcauggccaucagcggcgacgacugcguggugaagcccaucgacgaccgguucgcgaacgcccugcuggcccucaacgacauggggaagguccgcaaggacaucccccaguggcagccguccaagggcuggcacgacuggcagcagguccccuucugcagccaccacuuccacgagcugaucaugaaggacgggcggaagcuggugguccccugccgcccccaggacgagcucaucggccgcgcccggaucucccagggggccggcuggagccugaaggagaccgcgugccugggcaaggccuacgcccagauguggucccucauguacuuccaccgccgggaccugcgccuggccagcaacgccaucugcuccgcggugccggugcacuggguccccaccagccggaccacguggagcauccacgcccaccaccaguggaugaccaccgaggacaugcucaccguguggaaccgcguguggaucgaggacaaccccuggauggaggacaagacgcccgucaccaccugggaggacgugccguaccuggggaagcgggaggaccaguggugcggcucccugaucgggcucaccagccgcgccacgugggcccagaacauccugaccgcgauccagcagguccggucccugaucggcgacgaggaguuccucgacuacaugcccagcaugaagcgcuuccggaaggaggaggaguccgagggggccaucugguga

SEQ ID NO: 10417 - RNA, 9867 nt, Artificial Sequence
  derived and/or modified CDS sequence (opt1) from DENV-4__KR922405__SS-prME
agcaccaucacccugcucugccugauccccacggugauggccuuccaccuguccacccgcgacggcgagccgcucaugaucgucgccaagcacgagcgggggcgcccccugcuguucaagaccaccgagggcaucaacaagugcacgcucaucgcgauggaccugggggagaugugcgaggacaccgugaccuacaagugcccccugcucgugaacaccgagcccgaggacaucgacugcuggugcaaccugacgagcgccugggucauguacggcaccugcacccaguccggggagcggcgccgggagaagcgcagcguggcccugaccccgcacuccggcaugggccucgagacgcgggccgagaccuggaugagcuccgagggggccuggaagcacgcgcagcgcguggagagcuggauccugcggaaccccggcuucgcccugcucgccggguucauggccuacaugaucggccagaccgggauccagcgcaccgucuucuucauccugaugaugcugguggcgcccuccuacggcaugcggugcgugggcgucgggaaccgcgacuucguggagggcgugagcgggggcgccugggucgaccucgugcuggagcacggcgggugcgugacgaccauggcccagggcaagcccacccuggacuucgagcucaucaagaccacggccaaggaggucgcccugcugcggaccuacugcaucgaggcguccaucagcaacaucaccaccgccacgcgcugcccgacccagggggagcccuaccucaaggaggagcaggaccagcaguacaucugccggcgcgacaugguggaccggggcugggggaacggcugcggccuguucgggaagggcgggguggucaccugcgccaaguucuccugccugggcaagaucaccgggaaccucgugcagaucgagaaccuggaguacacgguggucgugaccgugcacaacggcgacacccacgccgucggcaacgacaccagcaaccacggggugacggccaccaucaccccccgcucccccagcgucgaggugaagcugccggacuacggcgagcucacccuggacugcgagccccgguccgggaucgacuucaacgagaugauccugaugaagaugaagacgaagaccuggcucgugcacaagcagugguuccuggaccugccccuccccuggaccaccggcgcggacacccuggagguccacuggaaccacaaggagcgcauggugacguucaaggugccgcacgccaagcggcaggacgucaccgugcuggggagccaggagggcgccaugcacuccgcccucgccggcgcgaccgagguggacagcggggacggcaaccacauguucgccgggcaccugaagugcaagguccgcauggagaagcugcgcaucaagggcaugagcuacaccaugugcuccggcaaguucagcaucgacaaggagauggccgagacgcagcacgggaccaccguggugaaggucaaguacgagggcaccggggcccccugcaaggugcccaucgagauccgggacgugaacaaggagaaggucgugggccgcaucaucuccagcacgcccuucgccgagaacaccaacuccgugaccaacaucgagcucgagccgcccuucggggacagcuacaucgucaucggcgugggcgacuccgcgcugacccugcacugguuccggaaggggagcuccaucggcaagauguucgagagcacguaccgcggggccaagcggauggccauccucggcgagaccgccugggacuucggguccgugggcggccugcugaccagccucgggaaggcgguccaccagguguucggcuccguguacaccacgauguucgggggcgucagcuggauggugcgcauccugaucgggcugcuggugcucuggaucggcaccaacucccggaacaccagcauggccauguccugcaucgccgucggcgggaucacccuguuccugggcuucacggugcacgccgacauggggugcguggucagcugguccggcaaggagcucaagugcgggagcggcaucuucgugaucgacaacgugcacaccuggaccgagcaguacaaguuccagcccgagagccccgcccgccuggcguccgccauccugaacgcccacaaggagggcgucugcgggauccggagcaccacgcgccucgagaacgugauguggaagcagaucaccaacgagcugaacuacgugcugugggagggcgggcacgaccucaccgucguggccggcgacgugaagggcguccuguccaaggggaagcgggcccuggcgccgcccgugaacgaccucaaguacagcuggaagaccuggggcaaggccaagaucuucacgcccgagacccgcaacuccaccuuccugguggacgggcccgacaccagcgagugcccgaacgagcggcgcgccuggaacuuccuggaggucgaggacuacggcuucgggauguucacgaccaacaucuggaugaaguuccgggagggcuccagcgaggugugcgaccaccgccucauguccgccgccaucaaggaccagaaggcggugcacgccgacaugggcuacuggaucgagagcuccaagaaccagaccuggcagaucgagaaggccagccugaucgaggucaagaccugccuguggcccaagacgcacacccucugguccaacggggugcuggagagccagaugcugauccccaaggccuacgcgggcccgaucucccagcacaacuaccggcagggguacgccacccagaccgccggccccuggcaccucgggaagcuggagaucgacuucggcgagugccccggcaccacggugaccauccaggaggacugcgaccaccgcgggcccagccugcggaccaccacggccuccggcaagcucgucacccaguggugcugccgcagcugcaccaugccgccccugcgcuuccugggggaggacggcugcugguacgggauggagauccggccccucaacgagaaggaggagaacauggugaagagccagguguccgccggccagggcaccagcgagacguucuccauggggcugcugugccucacccuguucgucgaggagugccugcgccggcgcgugacccggaagcacaugauccucgucguggugaccacgcugugcgcgaucauccugggcgggcucaccuggauggaccugcugcgcgcccucaucaugcugggcgacaccaugagcggccggauggggggccagauccaccuggccaucauggccgucuucaagaugucccccggguacgugcucggcaucuuccugcgcaagcugaccagccgggagacggcccucauggugaucgggauggcgaugaccaccguccuguccaucccgcacgaccugauggaguucaucgacggcaucagccucggccugauccugcucaagauggugacccacuucgacaacacgcagguggggacccuggcccuggcccucaccuucaucaaguccaccaugccccuggucauggccuggcgcacgaucauggccgugcuguucguggucacccucaucccccugugccggaccagcugccugcagaagcagucccacuggguggagaucaccgcgcucauccugggcgcccaggcccugcccguguaccucaugacgcugaugaagggggccagcaagcgcuccuggccgcugaacgagggcaucauggcggucgggcucgugagccugcugggcuccgcccuccugaagaacgacgugccccuggccggccccauggucgccgggggccuccugcuggccgcguacgugaugagcggguccagcgccgaccucucccuggagaaggccgccaacgugcagugggacgagauggccgacaucaccggcagcagccccaucaucgaggucaagcaggacgaggacggguccuucagcauccgggacguggaggagaccaacaugaucacccugcucgugaagcuggcgcugaucacggucuccggccucuacccgcuggccauccccgugaccaugacccugugguacauguggcaggugaagacccagcgcagcggcgcccucugggacguccccucccccgccgccgcgcagaaggccacgcugaccgaggggguguaccggaucaugcagcgcggccuguucgggaagacccaggugggcgucgggauccacaccgagggcguguuccacaccauguggcacgugacgcggggcagcgucaucugccacgaguccgggcgccucgagccgagcugggccgacgugcggaacgacaugaucuccuacggcgggggcuggcgccugggcgacaagugggacaaggaggaggacgugcagguccuggccaucgagcccgggaagaaccccaagcacgugcagaccaagcccggccucuucaagacccugaccggggagaucggcgccgugacgcuggacuucaagccggggaccagcggcucccccaucaucaaccggaagggcaaggucaucgggcucuacggcaacgggguggugaccaagagcggcgacuacgucuccgcgaucacccaggccgagcgcaucggggagcccgacuacgagguggacgaggacaucuuccgcaagaagcggcugacgaucauggaccugcacccgggcgccggcaagaccaagcgcauccugcccagcaucgugcgggaggcccucaagcgccggcugcgcacccugauccucgcgcccacccgggucguggccgccgagauggaggaggcccugcgcgggcugcccauccgguaccagacgccggccgugaaguccgagcacaccggccgcgagaucgucgaccucaugugccacgcgaccuucaccacgcggcugcugagcuccacccgcgugcccaacuacaaccucaucgugauggacgaggcccacuucaccgaccccagcuccgucgccgcccggggguacaucagcacccgcguggagaugggcgaggccgcggccaucuucaugacggccacccccccggggaccaccgaccccuucccccagagcaacucccccaucgaggacaucgagcgggagaucccggagcgcagcuggaacacgggcuucgacuggaucaccgacuaccagggcaagaccgucugguucgugcccuccaucaaggccgggaacgacaucgccaacugccugcggaagagcggcaagaaggugauccagcugucccgcaagaccuucgacacggaguaccccaagaccaagcucaccgacugggacuucgucgugaccacggacaucagcgagaugggggcgaacuuccgggccggccgcgugaucgacccccgccggugccugaagccggucauccugaccgacgggcccgagcgcgugauccucgccggccccauccccgugaccccggccuccgcggcccagcggcgcggccggaucgggcgcaaccccgcccaggaggacgaccaguacgucuucagcggcgacccccugcggaacgacgaggaccacgcccacuggaccgaggccaagaugcugcucgacaacaucuacacgcccgaggggaucaucccgacccuguucggccccgagcgcgagaagacccaggcgaucgacggcgaguuccggcugcgcggggagcagcggaagaccuucguggagcucaugcgccggggcgaccugcccguguggcuguccuacaaggucgccagcgccgggaucuccuacaaggaccgcgaguggugcuucacgggcgagcggaacaaccagauccucgaggagaacauggagguggagaucuggacccgcgagggggagaagaagaagcugcggcccaaguggcuggacgcccgcguguacgccgacccgauggcgcucaaggacuucaaggaguucgccagcggccggaaguccaucacccuggacauccugaccgagaucgccagccuccccauguaccuguccagccgcgccaagcuggcccucgacaacaucgucaugcugcacaccacggagcggggcgggaaggcguaccagcacgcccugaacgagcuccccgagucccuggagacccugaugcucguggcccugcugggcgccaugaccgcggggaucuuccucuucuucaugcagggcaaggggaucggcaagcugagcaugggccugaucgccaucgccguggccuccgggcuccugugggucgccgagauccagccgcaguggaucgcggccagcaucauccuggaguucuuccucauggugcugcuggugcccgagcccgagaagcagcgcaccccccaggacaaccagcucaucuacgucauccugacgauccugaccaucaucgcccucguggccgccaacgagaugggccugaucgagaagaccaagaccgacuucggguucuaccaggugaaggcggagacgaccauccuggacgucgaccuccgcccggccagcgccuggacccuguacgccguggccaccacgauccugacccccaugcuccggcacaccaucgagaacaccuccgcgaaccugagccuggccgccaucgccaaccaggccgcggugcucaugggccuggggaagggcuggccccugcaccgcauggaccucggcgucccccugcuggccauggggugcuacucccaggugaacccgacgacccucaccgccagccuggugaugcugcucguccacuacgccaucaucggccccgggcugcaggcgaaggccacccgggaggcccagaagcgcacggccgccggcaucaugaagaaccccaccguggacggcaucaccgugaucgaccuggagcccaucuccuacgacccgaaguucgagaagcagcucgggcaggucaugcugcuggugcucugcgcgggccagcugcugcucaugcggaccacgugggccuucugcgaggugcugacccuggccaccgggcccauccucacccugugggagggcaaccccgggcgcuucuggaacacgaccaucgccgucagcaccgccaacaucuuccggggcuccuaccuggcgggcgccgggcucgccuucagccugaucaagaacgcccagaccccccgccggggcacggggaccaccggcgagacccugggggagaaguggaagcgccagcucaacucccuggaccggaaggaguucgaggaguacaagcgcagcggcauccuggagguggaccggacggaggccaaguccgcgcucaaggacggcagcaagaucaaguucgccgugucccgcgggaccagcaagauccgguggaucgucgagcgcggcauggugaagccgaaggggaagguggucgaccugggcugcgggcggggcggcugguccuacuacauggccacccugaagaacgugaccgaggugaagggguacaccaagggcgggcccggccacgaggagcccguccccauggccacguacggguggaaccucgugaagcugcacagcggcguggacgucuucuacaagccgaccgagcagguggacacccugcucugcgacaucggcgaguccagcuccaaccccaccaucgaggaggggcgcacgcugcgggugcugaagauggucgagcccuggcugagcagcaagcccgaguucugcaucaaggugcucaacccguacaugcccaccgucaucgaggagcuggagaagcugcagcgccgccacggcgggucccucgugcggugcccccugagccgcaacuccacccacgagauguacugggugagcggcgucuccggcaacaucgugagcuccgugaacaccacgagcaagaugcugcucaaccgguucaccacccgccaccggaagcccaccuacgagaaggacgcggaccugggggccggcacgcgcuccgucagcaccgagaccgagaagccggacaugaccaucaucgggcggcgccugcagcggcuccaggaggagcacaaggagacguggcacuacgaccacgagaaccccuaccgcaccugggccuaccacggcuccuacgaggcccccagcaccggguccgccagcuccauggugaacggcguggucaagcugcugaccaagccgugggacguggugcccauggucacgcagcucgcgaugaccgacaccacccccuucggccagcagcggguguucaaggagaagguggacacgcgcaccccccagccgaagcccgggacccgggucaucaugaccacgaccgccaacuggcuguggacccugcucggccgcaagaagaacccccggcugugcacccgcgaggaguucaucagcaaggugcgguccaacgccgccaucggggccguguuccaggaggagcagggcuggacgagcgcguccgaggccgucaacgacagccgcuucugggagcugguggacaaggagcgggcccuccaccaggaggggaagugcgagagcugcguguacaacaugaugggcaagcgcgagaagaagcugggcgaguucgggcgggccaagggcucccgcgccaucugguacauguggcugggggcgcgcuuccucgaguucgaggcccugggcuuccugaacgaggaccacugguucgggcgggagaacagcugguccggcgucgagggcgaggggcuccaccgccugggcuacauccuggaggacaucgacaagaaggacggggaccucaucuacgccgacgacaccgccggcugggacacccggaucaccgaggacgaccugcugaacgaggagcucaucacggagcagauggcgccccaccacaagauccuggccaaggccaucuucaagcugaccuaccagaacaagguggugaagguccuccgcccgacccccaagggcgccgugauggacaucaucagccggaaggaccagcgcggguccggccagguggggaccuacggccugaacaccuucacgaacauggagguccagcugauccggcagauggaggccgagggggugaucacccaggacgacaugcacaaccccaagggccucaaggagcgcguggagaaguggcugaaggagugcggcgucgaccggcugaagcgcauggcgaucagcggggacgacugcguggugaagccccucgacgagcgguucuccaccagccugcuguuccucaacgacaugggcaagguccgcaaggacaucccgcagugggagcccuccaagggguggaagaacuggcaggaggugcccuucugcagccaccacuuccacaagaucuucaugaaggacggccggucccuggugguccccugccgcaaccaggacgagcugaucgggcgggcccgcaucagccagggcgccggcuggucccuccgggagaccgccugccuggggaaggccuacgcgcagauguggagccugauguacuuccaccgccgggaccuccgccuggccuccauggccaucugcagcgccgugccgacggagugguuccccaccucccgcaccaccuggagcauccacgcccaccaccaguggaugacgaccgaggacaugcugaagguguggaaccgggucuggaucgaggacaaccccaacaugaucgacaagacccccgugcacagcugggaggacaucccguaccucggcaagcgcgaggaccuguggugcgggucccugaucggccucagcucccgggcgaccugggccaagaacauccacacggccaucacccaggugcgcaaccugaucgggaaggaggaguacgucgacuacaugcccgccaugcggcgcuacagcgcccacuucgaguccgagggcgugcuguga

SEQ ID NO: 10418 - RNA, 9867 nt, Artificial Sequence
  derived and/or modified CDS sequence (opt1) from DENV-4__KP188557__SS-prME
agcaccaucacccugcucugccugauccccacggugauggccuuccaccuguccacccgcgacggcgagccgcucaugaucgucgccaagcacgagcgggggcgcccccugcuguucaagaccaccgagggcaucaacaagugcacgcucaucgcgauggaccugggggagaugugcgaggacaccgugaccuacaagugcccccugcucgugaacaccgagcccgaggacaucgacugcuggugcaaccugacgagcaccugggucauguacggcaccugcacccaguccggggagcggcgccgggagaagcgcagcguggcccugacgccgcacuccggcaugggccucgagacccgggccgagaccuggaugagcuccgagggggccuggaagcacgcccagcgcguggagagcuggauccugcggaaccccggcuucgcgcugcucgccggguucauggccuacaugaucggccagaccgggauccagcgcacggucuucuucgugcugaugaugcugguggcccccuccuacggcaugcggugcgucggcguggggaaccgcgacuucguggagggcgucagcgggggcgcguggguggaccucgugcuggagcacggcgggugcgucaccaccauggcccagggcaagcccacccuggacuucgagcucacgaagaccaccgccaaggagguggcccugcugcggaccuacugcaucgaggcccucaucuccaacaucacgaccgcgacccgcugcccgacccagggggagcccuaccugaaggaggagcaggaccagcaguacaucugccggcgcgacguggucgaccggggcugggggaacggcugcggccuguucgggaagggcgggguggugacgugcgccaaguucagcugcuccggcaagaucaccgggaaccucguccagaucgagaaccuggaguacaccgugguggucaccgugcacaacggcgacacgcacgccgucggcaacgacaccagcaaccacggggugaccgccaccaucacgccccgcucccccagcguggaggucaagcugccggacuacggcgagcucacccuggacugcgagccccgguccgggaucgacuucaacgagaugauccugaugaagaugaagaagaagaccuggcucgugcacaagcagugguuccuggaccugccccuccccuggaccaccggcgccgacacgagcgaggugcacuggaacuacaaggagcgcauggucaccuucaaggugccgcacgcgaagcggcaggacgugaccguccuggggucccaggagggcgccaugcacagcgcccuggccggcgccaccgagguggacagcggggacggcaaccacauguucgcggggcaccucaagugcaaggugcgcauggagaagcugcgcaucaagggcauguccuacacgaugugcagcggcaaguucuccaucgacaaggagauggccgagacccagcacgggaccaccgucgugaaggugaaguacgagggcgccggggcccccugcaagguccccaucgagauccgggacgugaacaaggagaagguggucggccgcgugaucagcgccacgccccuggcggagaacaccaacuccgugaccaacaucgagcucgagccgcccuucggggacagcuacaucgucaucggcgugggcaacuccgcccugacccugcacugguuccggaaggggagcuccaucggcaagauguucgagagcacguaccgcggggccaagcggauggccauccucggcgagaccgcgugggacuucggguccgugggcggccuguucaccagccuggggaaggccguccaccagguguucggcuccguguacaccacgauguucgggggcgucagcuggaugauccgcauccucaucggguuccuggugcuguggaucggcaccaacucccggaacaccagcauggccaugaccugcaucgccgugggcgggaucacgcuguuccucggcuucaccguccaggccgacauggggugcgugguguccuggagcggccgcgagcugaagugcggguccggcaucuucgucguggacaacgugcacaccuggaccgagcaguacaaguuccagcccgagagccccgcgcggcuggccagcgccauccucaacgcccacaaggacggcgucugcgggauccgcuccacgacccggcuggagaacgugauguggaagcagaucaccaacgagcugaacuacgugcucugggagggcgggcacgaccugaccgucguggccggcgacgugaagggcguccugacgaaggggaagcgcgcgcucaccccgcccgccagcgaccugaaguacuccuggaagaccuggggcaaggcccggaucuucacccccgaggcccgcaacaacacguuccugaucgacgggcccgacaccagcgagugcccgaacgagcggcgcgccuggaacuccuucgagguggaggacuacggcuucgggauguucaccaccaacaucuggaugaaguuccgggagggcagcuccgaggugugcgaccaccgccucaugagcgcggccaucaaggaccagaaggccguccacgccgacaugggcuacuggaucgaguccagcaagaaccagacguggcagaucgagcgggcgucccugaucgaggugaagaccugccuguggcccaagacccacacccucuggagcaacggggugcuggagucccagaugcugauccccaagagcuacgccggcccguucucccagcacaacuaccgccagggguacgccacccagacggucggccccuggcaccucgggaagcuggagaucgacuucggcgagugccccggcaccaccgugaccauccaggagaacugcgaccaccgcgggcccagccugcggacgaccaccgccuccggcaagcucgugacccaguggugcugccgcagcugcacgaugccgccccugcgguuccugggggaggacggcugcugguacgggauggagauccgcccccucagcgagaaggaggagaacauggucaagucccaggugaccgccggccagggcaccagcgagaccuucuccauggggcugcugugccucacgcuguucgucgaggagugccugcggcgccgggugacccgcaagcacaugauccucgcgguggucaucacccugugcgccaucauccugggcgggcucaccuggauggaccugcugcgggcccucaucaugcugggcgacacgaugagcggccgcaucgggggccagacccaccuggccaucauggccguguucaagaugucccccggguacgugcucggcgucuuccugcggaagcugaccagccgcgagaccgcgcucauggugaucgggauggccaugacgaccacccuguccaucccgcacgaccugauggagcucaucgacggcaucagccugggccugauccuccugaagaucgugacccaguucgacaacacgcaggucgggacccuggcccucucccugaccuucauccggagcaccaugucccuggugauggccuggcgcacgaucauggccgugcucuucgucgugacccugaucccccugugccggaccagcugccuccagaagcagucccacuggguggagaucaccgcgcugauccugggcgcccaggcccuccccgucuaccugaugacgcugaugaagggggccagccgccgguccuggccccucaacgagggcaucauggcgguggggcuggugagccugcucggcuccgcccugcugaagaacgacgucccgcucgccggccccaugguggccgggggccugcugcucgccgcguacgugaugagcggguccagcgccgaccugagccuggagaaggccgccaacguccgcugggacgagauggccgacaucaccggcuccagccccaucaucgaggugaagcaggacgaggacggguccuucagcauccgggacguggaggagaccaacaugaucacccuccuggucaagcuggcgcucaucacgguguccggccuguacccccuggccaucccgaucaccaugacccucugguacauguggcaggugaagacccagcgcagcggcgcccugugggacguccccucccccgccgccacccagaaggcggcccugagcgaggggguguaccggaucaugcagcgcggccucuucgggaagacgcaggugggcgucgggauccacauggagggcguguuccacaccauguggcacgugacccgcggcuccgucaucugccacgagaccgggcggcuggagcccagcugggccgacgugcgcaacgacaugaucuccuacggcgggggcuggcggcugggcgacaagugggacaaggaggaggacgugcagguccucgccaucgagccggggaagaaccccaagcacgugcagacgaagcccggccuguucaagacccugaccggggagaucggcgccgugacccucgacuucaagcccgggacgagcggcuccccgaucaucaaccgcaagggcaaggucaucgggcuguacggcaacgggguggugaccaagagcggcgacuacgucuccgcgaucacccaggccgagcggaucggggagcccgacuacgagguggacgaggacaucuuccgcaagaagcggcugaccaucauggaccuccaccccggcgccggcaagacgaagcgcauccugccgagcaucgugcgggaggcccugaagcgccggcugcgcacccucauccuggcgcccacccgggucguggccgccgagauggaggaggcccugcgcgggcuccccauccgguaccagacccccgccgugaaguccgagcacacgggccgcgagaucgucgaccugaugugccacgcgaccuucaccacccggcugcucagcuccacgcgcgugccgaacuacaaccugaucgugauggacgaggcccacuucaccgaccccagcagcgucgccgcccggggguacaucuccacccgcguggagaugggcgaggccgcggccaucuucaugaccgccacgccccccggggccaccgacccguucccccagagcaacucccccaucgaggacaucgagcgcgagauccccgagcggagcuggaacaccggcuucgacuggaucaccgacuaccagggcaagacggucugguucgugccguccaucaaggccgggaacgacaucgcgaacugccugcgcaagagcggcaagaaggugauccagcucucccggaagaccuucgacaccgaguaccccaagaccaagcugacggacugggacuucgucgugaccaccgacaucagcgagaugggggccaacuuccgcgccggccgggugaucgacccccgccggugccugaagcccgucauccucaccgacgccccggagcgcgugauccuggcggggcccauccccgugacgcccgccuccgccgcccagcggcgcggccggaucggccgcaacccggcccaggaggacgaccaguacgucuucagcggggacccccugaagaacgacgaggaccacgcgcacuggaccgaggccaagaugcuccuggacaacaucuacacccccgagggcaucauccccacccuguucgggccggagcgggagaagacgcaggccaucgacggcgaguuccgccuccggggcgagcagcgcaagaccuucguggagcugaugcggcgcggggaccugcccguguggcucuccuacaaggucgccagcgccggcaucuccuacaaggaccgggaguggugcuucaccggggagcgcaacaaccagauccuggaggagaacauggagguggagaucuggacccgggagggcgagaagaagaagcugcgccccaaguggcucgacgcgcgcguguacgccgaccccauggcccugaaggacuucaaggaguucgccagcgggcggaaguccaucacccuggacauccucacggagaucgccagccugccgaccuaccuguccagccgcgcgaagcucgcccuggacaacaucgucaugcugcacaccaccgagcggggcggccgcgccuaccagcacgcccucaacgagcugcccgagucccuggagacgcucaugcugguggcgcugcucggggccaugaccgccggcaucuuccuguucuucaugcaggggaagggcaucgggaagcugagcaugggccucaucaccaucgccguggccagcggccugcugugggucgcggagauccagccccaguggaucgccgccuccaucauccucgaguucuuccugauggugcugcucaucccggagcccgagaagcagcggaccccccaggacaaccagcugaucuacgugauccugacgauccucaccaucaucgggcugaucgccgccaacgagaugggccugaucgagaagaccaagaccgacuucggguucuaccaggucaagacggagaccaccauccucgacguggaccugcgccccgcgagcgccuggacccuguacgccguggccacgaccauccucaccccgaugcugcggcacaccaucgagaacacguccgccaaccugagccucgcggccaucgccaaccaggccgccguccugaugggccuggggaagggcuggccccuccaccgcauggaccugggcgugccccugcucgcgauggggugcuacucccaggugaaccccaccacccugaccgccagccuggucaugcuccuggugcacuacgccaucaucggcccggggcugcaggccaaggcgacgcgggaggcccagaagcgcaccgccgccggcaucaugaagaaccccaccguggacggcaucaccgucaucgaccucgagcccaucuccuacgaccccaaguucgagaagcagcuggggcaggugaugcugcucgugcugugcgccggccagcugcuccugaugcggacgaccugggcguucugcgagguccugacccucgccaccgggccgauccugacgcugugggagggcaaccccgggcgcuucuggaacaccaccaucgccgugagcaccgccaacaucuuccggggcuccuaccucgccggcgcggggcuggccuucagccugaucaagaacgcccagacgccccgccggggcaccgggaccgccggcgagacccucggggagaaguggaagcgccagcugaacucccuggaccggaaggaguucgaggaguacaagcgcagcggcauccucgagguggaccggaccgaggccaaguccgcgcugaaggacggcagcaagaucaagcacgccgucucccgcgggagcuccaagauccgcuggaucguggagcggggcauggugaagcccaaggggaaggucguggaccugggcugcgggcgcggcggcuggagcuacuacauggccacgcucaagaacgugaccgaggucaagggguacaccaagggcgggccgggccacgaggagcccauccccauggccaccuacggguggaaccuggugaagcugcacuccggcguggacgucuucuacaagcccacggagcagguggacacccuccugugcgacaucggcgagagcagcuccaacccgaccaucgaggaggggcggacccugcgcgugcucaagauggucgagcccuggcugagcuccaagcccgaguucugcaucaaggugcugaaccccuacaugccgacggugaucgaggagcuggagaagcuccagcggaagcacggcgggaaccugguccgcugcccccugagccggaacuccacccacgagauguacugggugagcggcgcguccggcaacaucgucagcuccgugaacaccaccagcaagaugcuccugaaccgcuucacgacccggcaccgcaagcccaccuacgagaaggacguggaccugggggccggcacccgguccgucagcacggagaccgagaagcccgacaugaccaucaucgggcgccggcuccagcgccugcaggaggagcacaaggagaccuggcacuacgaccaggagaacccguaccggacgugggccuaccacggcuccuacgaggcccccagcaccggguccgccagcuccauggugaacggcguggucaagcugcucaccaagcccugggacgugaucccgauggugacccagcuggcgaugacggacaccacccccuucggccagcagcgcgucuucaaggagaagguggacacccggacgccccagcccaagccggggacccgcauggugaugaccaccacggccaacuggcugugggcccuccugggcaagaagaagaacccccggcugugcacccgcgaggaguucaucagcaagguccgguccaacgccgccaucggggcgguguuccaggaggagcagggcuggaccagcgccagcgaggccgugaacgacucccgcuucugggagcucgucgacaaggagcgcgcccugcaccaggaggggaagugcgagagcugcguguacaacaugaugggcaagcgggagaagaagcugggcgaguucgggcgcgccaagggcucccgggcgaucugguacauguggcucggggcccgcuuccuggaguucgaggcccugggcuuccucaacgaggaccacugguucgggcgggagaacagcugguccggcguggagggcgaggggcugcaccgccugggcuacauccucgaggagaucgacaagaaggacggggaccugauguacgccgacgacaccgcgggcugggacacgcggaucaccgaggacgaccugcagaacgaggagcucaucaccgagcagauggccccccaccacaagauccuggccaaggccaucuucaagcugaccuaccagaacaaggucgugaaggugcuccgccccaccccgcggggcgccgucauggacaucaucagccgcaaggaccagcggggguccggccagguggggacguacggccugaacaccuucaccaacauggaggugcagcugauccgccagauggaggcggagggggucaucacccaggacgacaugcagaaccccaagggccucaaggagcggguggagaaguggcugcgcgagugcggcguggaccggcugaagcgcauggccaucagcggggacgacugcgucgugaagccccucgacgagcgguucggcacgucccugcuguuccucaacgacauggggaaggugcgcaaggacaucccccagugggagccgagcaagggcuggaagaacuggcaggagguccccuucugcucccaccacuuccacaagaucuucaugaaggacgggcggagccugguggugcccugccgcaaccaggacgagcugaucggccgcgcccggaucucccagggcgccggguggagccuccgcgagaccgccugccugggcaaggcguacgcccagauguggucccugauguacuuccaccggcgcgaccuccggcuggccagcauggccaucugcuccgccguccccaccgagugguucccgaccagccgcacgaccuggagcauccacgcgcaccaccaguggaugaccaccgaggacaugcugaagguguggaaccggguguggaucgaggacaaccccaacaugaucgacaagacgcccguccacuccugggaggacauccccuaccucgggaagcgcgaggaccuguggugcggcagccugaucgggcucuccagccgggccaccugggccaagaacauccacaccgccaucacccaggugcgcaaccugaucggcaaggaggaguacguggacuacaugccggucaugaagcgguacuccgcccccagcgaguccgagggcgugcuguga

SEQ ID NO: 10419 - RNA, 9867 nt, Artificial Sequence
  derived and/or modified CDS sequence (opt1) from DENV-4__KP188558__SS-prME
agcaccaucacccugcucugccugauccccacggugauggccuuccaccuguccacccgcgacggcgagccgcucaugaucgucgccaagcacgagcgggggcgcccccugcuguucaagaccaccgagggcaucaacaagugcacgcucaucgcgauggaccugggggagaugugcgaggacaccgugaccuacaagugcccccugcucgugaacaccgagcccgaggacaucgacugcuggugcaaccugacgagcaccugggucauguacggcaccugcacccaguccggggagcggcgccgggagaagcgcagcguggcccugacgccgcacuccggcaugggccucgagacccgggccgagaccuggaugagcuccgagggggccuggaagcacgcccagcgcguggagagcuggauccugcggaaccccggcuucgcgcugcucgccggguucauggccuacaugaucggccagaccgggauccagcgcacggucuucuucgugcugaugaugcugguggcccccuccuacggcaugcggugcgucggcguggggaaccgcgacuucguggagggcgucagcgggggcgcguggguggaccucgugcuggagcacggcgggugcgucaccaccauggcccagggcaagcccacccuggacuucgagcucacgaagaccaccgccaaggagguggcccugcugcggaccuacugcaucgaggcccucaucuccaacaucacgaccgcgacccgcugcccgacccagggggagcccuaccugaaggaggagcaggaccagcaguacaucugccggcgcgacguggucgaccggggcugggggaacggcugcggccuguucgggaagggcgggguggugacgugcgccaaguucagcugcuccggcaagaucaccgggaaccucguccagaucgagaaccuggaguacaccgugguggucaccgugcacgacggcgacacgcacgccgucggcaacgacaccagcaaccacggggugaccgccaccaucacgccccgcucccccagcguggaggucaagcugccggacuacggcgagcucacccuggacugcgagccccgguccgggaucgacuucaacgagaugauccugaugaagaugaagaagaagaccuggcucgugcacaagcagugguuccuggaccugccccuccccuggaccaccggcgccgacacgagcgaggugcacuggaacuacaaggagcgcauggucaccuucaaggugccgcacgcgaagcggcaggacgugaccguccuggggucccaggagggcgccaugcacagcgcccuggccggcgccaccgagguggacagcggggacggcaaccacauguucgcggggcaccucaagugcaaggugcgcauggagaagcugcgcaucaagggcauguccuacacgaugugcagcggcaaguucuccaucgacaaggagauggccgagacccagcacgggaccaccgucgugaaggugaaguacgagggcgccggggcccccugcaagguccccaucgagauccgggacgugaacaaggagaagguggucggccgcgugaucagcgccacgccccuggcggagaacaccaacuccgugaccaacaucgagcucgagccgcccuucggggacagcuacaucgucaucggcgugggcaacuccgcccugacccugcacugguuccggaaggggagcuccaucggcaagauguucgagagcacguaccgcggggccaagcggauggccauccucggcgagaccgcgugggacuucggguccgugggcggccuguucaccagccuggggaaggccguccaccagguguucggcuccguguacaccacgauguucgggggcgucagcuggaugauccgcauccucaucggguuccuggugcuguggaucggcaccaacucccggaacaccagcauggccaugaccugcaucgccgugggcgggaucacgcuguuccucggcuucaccguccaggccgacauggggugcgugguguccuggagcggccgcgagcugaagugcggguccggcaucuucgucguggacaacgugcacaccuggaccgagcaguacaaguuccagcccgagagccccgcgcggcuggccagcgccauccucaacgcccacaaggacggcgucugcgggauccgcuccacgacccggcuggagaacgugauguggaagcagaucaccaacgagcugaacuacgugcucugggagggcgggcacgaccugaccgucguggccggcgacgugaagggcguccugacgaaggggaagcgcgcgcucaccccgcccgccagcgaccugaaguacuccuggaagaccuggggcaaggccaagaucuucacccccgaggcccggaacagcacguuccugaucgacgggcccgacaccuccgagugcccgaacgagcgccgggccuggaacagcuucgagguggaggacuacggcuucgggauguucaccaccaacaucuggaugaaguuccgcgagggcuccagcgaggugugcgaccaccggcucauguccgcggccaucaaggaccagaaggccguccacgccgacaugggcuacuggaucgagagcuccaagaaccagacguggcagaucgagcgcgcgagccugaucgaggugaagaccugccuguggcccaagacccacacccucugguccaacggggugcuggagagccagaugcugauccccaaguccuacgccggcccguucagccagcacaacuaccggcagggguacgccacccagacggucggccccuggcaccucgggaagcuggagaucgacuucggcgagugccccggcaccaccgugaccauccaggagaacugcgaccaccgcgggcccucccugcgcacgaccaccgccagcggcaagcucgugacccaguggugcugccggagcugcacgaugccgccccugcgcuuccugggggaggacggcugcugguacgggauggagauccggccccucuccgagaaggaggagaacauggucaagagccaggugaccgccggccagggcaccuccgagaccuucagcauggggcugcugugccucacgcuguucgucgaggagugccugcgccggcgcgugacccggaagcacaugauccucgcgguggucaucacccugugcgccaucauccugggcgggcucaccuggauggaccugcugcgcgcccucaucaugcugggcgacacgauguccggccggaucgggggccagacccaccuggccaucauggccguguucaagaugagccccggguacgugcucggcgucuuccugcgcaagcugaccucccgggagaccgcgcucauggugaucgggauggccaugacgaccacccugagcaucccgcacgaccugauggagcucaucgacggcaucucccugggccugauccuccugaagaucgugacccaguucgacaacacgcaggucgggacccuggcccucagccugaccuucauccgcuccaccaucagccuggugauggccuggcggacgaucauggccgugcucuucgucgugacccugaucccccugugccgcaccuccugccuccagaagcagagccacuggguggagaucaccgcgcugauccugggcgcccaggcccuccccgucuaccugaugacgcugaugaagggggccucccggcgcagcuggccccucaacgagggcaucauggcgguggggcuggugucccugcucggcagcgcccugcugaagaacgacgucccgcucgccggccccaugguggccgggggccugcugcucgccgcguacgugauguccgggagcagcgccgaccugucccuggagaaggccgccaacguccagugggacgagauggccgacaucaccggcagcucccccaucaucgaggugaagcaggacgaggacgggagcuucuccauccgggacguggaggagaccaacaugaucacccuccuggucaagcuggcgcucaucacggugagcggccuguacccccuggccaucccgaucaccaugacccucugguacauguggcaggugaagacccagcgcuccggcgcccugugggacguccccagccccgccgccacccagaaggcggcccuguccgaggggguguaccggaucaugcagcgcggccucuucgggaagacgcaggugggcgucgggauccacauggagggcguguuccacaccauguggcacgugacccggggcagcgucaucugccacgagaccgggcgccuggagcccuccugggccgacgugcgcaacgacaugaucagcuacggcgggggcuggcggcugggcgacaagugggacaaggaggaggacgugcagguccucgccaucgagccggggaagaaccccaagcacgugcagacgaagcccggccuguucaagacccugaccggggagaucggcgccgugacccucgacuucaagcccgggacguccggcagcccgaucaucaaccgcaagggcaaggucaucgggcuguacggcaacgggguggugaccaaguccggcgacuacgucagcgcgaucacccaggccgagcggaucggggagcccgacuacgagguggacgaggacaucuuccgcaagaagcggcugaccaucauggaccuccaccccggcgccggcaagacgaagcgcauccugccguccaucgugcgggaggcccugaagcgccggcugcgcacccucauccuggcgcccacccgggucguggccgccgagauggaggaggcccugcgcgggcuccccauccgguaccagacccccgccgugaagagcgagcacacgggccgcgagaucgucgaccugaugugccacgcgaccuucaccacccggcugcucuccagcacgcgcgugccgaacuacaaccugaucgugauggacgaggcccacuucaccgaccccagcuccgucgccgcccggggguacaucagcacccgcguggagaugggcgaggccgcggccaucuucaugaccgccacgccccccggggccaccgacccguucccccaguccaacagccccaucgaggacaucgagcgggagauccccgagcgcuccuggaacaccggcuucgacuggaucaccgacuaccagggcaagacggucugguucgugccgagcaucaaggccgggaacgacaucgcgaacugccugcgcaaguccggcaagaaggugauccagcucagccggaagaccuucgacaccgaguaccccaagaccaagcugacggacugggacuucgucgugaccaccgacaucuccgagaugggggccaacuuccgcgccggccgggugaucgacccccgccggugccugaagcccgucauccucaccgacgggccggagcgcgugauccuggccggccccauccccgugacgcccgcgagcgccgcccagcggcgcggccggaucgggcgcaacccggcccaggaggacgaccaguacgucuucuccggcgacccccugaagaacgacgaggaccacgcccacuggaccgaggcgaagaugcuccuggacaacaucuacacccccgaggggaucauccccacccuguucggcccggagcgggagaagacgcaggccaucgacggcgaguuccgccuccggggggagcagcgcaagaccuucguggagcugaugcggcgcggcgaccugcccguguggcucagcuacaaggucgccuccgccgggaucagcuacaaggaccgggaguggugcuucaccggcgagcgcaacaaccagauccuggaggagaacauggagguggagaucuggacccgggagggggagaagaagaagcugcgccccaaguggcucgacgcccggguguacgcggaccccauggcccugaaggacuucaaggaguucgccuccggccgcaagagcaucacccuggacauccucacggagaucgccucccugccgaccuaccugagcucccgcgccaagcucgcgcuggacaacaucgucaugcugcacaccaccgagcggggcgggcgcgccuaccagcacgcccucaacgagcugcccgagagccuggagacgcucaugcugguggcccugcucggcgcgaugaccgccgggaucuuccuguucuucaugcagggcaaggggaucggcaagcugagcaugggccucaucaccaucgccguggccuccgggcugcugugggucgccgagauccagccccaguggaucgcggccagcaucauccucgaguucuuccugauggugcugcucaucccggagcccgagaagcagcggaccccccaggacaaccagcugaucuacgugauccugacgauccucaccaucaucggccugaucgccgccaacgagauggggcugaucgagaagaccaagaccgacuucggcuucuaccaggucaagacggagaccaccauccucgacguggaccugcgccccgccuccgcguggacccuguacgccguggccacgaccauccucaccccgaugcugcggcacaccaucgagaacacgagcgccaaccugucccucgccgcgaucgccaaccaggccgccguccugauggggcugggcaagggcuggccccuccaccgcauggaccugggggugccccugcucgccaugggcugcuacagccaggugaaccccaccacccugaccgcgucccuggucaugcuccuggugcacuacgccaucaucgggccgggccugcaggccaaggccacgcgggaggcgcagaagcgcaccgccgccggcaucaugaagaaccccaccguggacgggaucaccgucaucgaccucgagcccaucagcuacgaccccaaguucgagaagcagcugggccaggugaugcugcucgugcugugcgccgggcagcugcuccugaugcggacgaccugggccuucugcgagguccugacccucgcgaccggcccgauccugacgcugugggaggggaaccccggccgcuucuggaacaccaccaucgccguguccaccgccaacaucuuccggggcagcuaccucgccggggccggccuggcguucucccugaucaagaacgcccagacgccccgccgggggaccggcaccgccggggagacccucggcgagaaguggaagcgccagcugaacagccuggaccggaaggaguucgaggaguacaagcgcuccggcauccucgagguggaccggaccgaggccaagagcgcccugaaggacggguccaagaucaagcacgcggucagccgcggcuccagcaagauccgguggaucguggagcgcgggauggugaagcccaagggcaaggucguggaccuggggugcggccgcggcgggugguccuacuacauggccacgcucaagaacgugaccgaggucaagggcuacaccaaggggggcccggggcacgaggagcccauccccauggccaccuacggcuggaaccuggugaagcugcacagcggcguggacgucuucuacaagcccacggagcagguggacacccuccugugcgacaucggggagagcuccagcaacccgaccaucgaggagggccggacccugcgcgugcucaagauggucgagcccuggcuguccagcaagcccgaguucugcaucaaggugcugaaccccuacaugccgacggugaucgaggagcuggagaagcuccagcggaagcacgggggcaaccugguccgcugcccccugucccggaacagcacccacgagauguacuggguguccggcgccagcgggaacaucgucuccagcgugaacaccaccuccaagaugcuccugaaccgcuucacgacccggcaccgcaagcccaccuacgagaaggacguggaccugggcgcggggacccggagcgucuccacggagaccgagaagcccgacaugaccaucaucggccgccggcuccagcgccugcaggaggagcacaaggagaccuggcacuacgaccaggagaacccguaccggacgugggccuaccacgggagcuacgaggcccccuccaccggcagcgccuccagcauggugaacggcguggucaagcugcucaccaagcccugggacgugaucccgauggugacccagcuggccaugacggacaccacccccuucgggcagcagcgcgucuucaaggagaagguggacacccggacgccccagcccaagccgggcacccgcauggugaugaccaccacggcgaacuggcugugggcccuccuggggaagaagaagaacccccggcugugcacccgcgaggaguucaucuccaagguccggagcaacgccgccaucggcgccguguuccaggaggagcagggguggaccagcgcguccgaggccgugaacgacagccgcuucugggagcucgucgacaaggagcgggcccugcaccaggagggcaagugcgaguccugcguguacaacaugaugggcaagcgcgagaagaagcugggggaguucggccgcgccaaggggagccgggccaucugguacauguggcucggcgcgcgcuuccuggaguucgaggcccugggguuccucaacgaggaccacugguucggccgggagaacuccuggagcggcguggagggggagggccugcaccgccugggguacauccucgaggagaucgacaagaaggacggcgaccugauguacgccgacgacaccgccggcugggacacgcggaucaccgaggacgaccugcagaacgaggagcucaucaccgagcagauggcgccccaccacaagauccuggccaaggccaucuucaagcugaccuaccagaacaaggucgugaaggugcuccgccccaccccgcggggggccgucauggacaucaucucccgcaaggaccagcggggcagcgggcaggugggcacguacgggcugaacaccuucaccaacauggaggugcagcugauccgccagauggaggccgagggcgucaucacccaggacgacaugcagaaccccaagggccucaaggagcggguggagaaguggcugcgcgagugcgggguggaccggcugaagcgcauggcgaucuccggcgacgacugcgucgugaagccccucgacgagcgguucgggacgagccugcuguuccucaacgacaugggcaaggugcgcaaggacaucccccagugggagccguccaagggguggaagaacuggcaggagguccccuucugcagccaccacuuccacaagaucuucaugaaggacggccggucccugguggugcccugccgcaaccaggacgagcugaucggccgggcccgcaucagccagggggccggcuggucccuccgcgagaccgccugccuggggaaggccuacgcgcagauguggagccugauguacuuccaccggcgcgaccuccggcuggccuccauggccaucugcagcgccguccccaccgagugguucccgaccagccgcacgaccugguccauccacgcccaccaccaguggaugaccaccgaggacaugcugaagguguggaaccggguguggaucgaggacaaccccaacaugaucgacaagacgcccguccacagcugggaggacauccccuaccucggcaagcgcgaggaccuguggugcgggucccugaucggccucagcucccgggcgaccugggccaagaacauccacaccgccaucacccaggugcgcaaccugaucggcaaggaggaguacguggacuacaugccggucaugaagcgguacagcgcccccuccgagagcgagggggugcuguga

SEQ ID NO: 10420 - RNA, 9867 nt, Artificial Sequence
  derived and/or modified CDS sequence (opt1) from DENV-4__KP188563__SS-prME
agcaccaucacccugcucugccugauccccacggugauggccuuccaccuguccacccgcgacggcgagccgcucaugaucgucgccaagcacgagcgggggcgcccccugcuguucaagaccaccgagggcaucaacaagugcacgcucaucgcgauggaccugggggagaugugcgaggacaccgugaccuacaagugcccccugcucgugaacaccgagcccgaggacaucgacugcuggugcaaccugacgagcaccugggucauguacggcaccugcacccaguccggggagcggcgccgggagaagcgcagcguggcccugacgccgcacuccggcaugggccucgagacccgggccgagaccuggaugagcuccgagggggccuggaagcacgcccagcgcguggagagcuggauccugcggaaccccggcuucgcgcugcucgccggguucauggccuacaugaucggccagaccgggauccagcgcacggucuucuucgugcugaugaugcugguggcccccuccuacggcaugcggugcgucggcguggggaaccgcgacuucguggagggcgucagcgggggcgcguggguggaccucgugcuggagcacggcgggugcgucaccaccauggcccagggcaagcccacccuggacuucgagcucacgaagaccaccgccaaggagguggcccugcugcggaccuacugcaucgaggcccucaucuccaacaucacgaccgcgacccgcugcccgacccagggggagcccuaccugaaggaggagcaggaccagcaguacaucugccggcgcgacguggucgaccggggcugggggaacggcugcggccuguucgggaagggcgggguggugacgugcgccaaguucagcugcuccggcaagaucaccgggaaccucguccagaucgagaaccuggaguacaccgugguggucaccgugcacaacggcgacacgcacgccgucggcaacgacaccagcaaccacggggugaccgccaccaucacgccccgcucccccagcguggaggucaagcugccggacuacggcgagcucacccuggacugcgagccccgguccgggaucgacuucaacgagaugauccugaugaagaugaagaagaagaccuggcucgugcacaagcagugguuccuggaccugccccuccccuggaccaccggcgccgacacgagcgaggugcacuggaacuacaaggagcgcauggucaccuucaaggugccgcacgcgaagcggcaggacgugaccguccuggggucccaggagggcgccaugcacagcgcccuggccggcgccaccgagguggacagcggggacggcaaccacauguucgcggggcaccucaagugcaaggugcgcauggagaagcugcgcaucaagggcauguccuacacgaugugcagcggcaaguucuccaucgacaaggagauggccgagacccagcacgggaccaccgucgugaaggugaaguacgagggcgccggggcccccugcaagguccccaucgagauccgggacgugaacaaggagaagguggucggccgcgugaucagcgccacgccccuggcggagaacaccaacuccgugaccaacaucgagcucgagccgcccuucggggacagcuacaucgucaucggcgugggcaacuccgcccugacccugcacugguuccggaaggggagcuccaucggcaagauguucgagagcacguaccgcggggccaagcggauggccauccucggcgagaccgcgugggacuucggguccgugggcggccuguucaccagccuggggaaggccguccaccagguguucggcuccguguacaccacgauguucgggggcgucagcuggaugauccgcauccucaucggguuccuggugcuguggaucggcaccaacucccggaacaccagcauggccaugaccugcaucgccgugggcgggaucacgcuguuccucggcuucaccguccaggccgacauggggugcgugguguccuggagcggccgcgagcugaagugcggguccggcaucuucgucguggacaacgugcacaccuggaccgagcaguacaaguuccagcccgagagccccgcgcggcuggccagcgccauccucaacgcccacaaggacggcgucugcgggauccgcuccacgacccggcuggagaacgugauguggaagcagaucaccaacgagcugaacuacgugcucugggagggcgggcacgaccugaccgucguggccggcgacgugaagggcguccugacgaaggggaagcgcgcgcucaccccgcccgccagcgaccugaaguacuccuggaagaccuggggcaaggccaagaucuucacccccgaggcccggaacagcacguuccugaucgacgggcccgacaccuccgagugcccgaacgagcgccgggccuggaacagcuucgagguggaggacuacggcuucgggauguucaccaccaacaucuggaugaaguuccgcgagggcuccagcgaggugugcgaccaccggcucauguccgcggccaucaaggaccagaaggccguccacgccgacaugggcuacuggaucgagagcuccaagaaccagacguggcagaucgagcgcgcgagccugaucgaggugaagaccugccuguggcccaagacccacacccucugguccaacggggugcuggagagccagaugcugauccccaaguccuacgccggcccguucagccagcacaacuaccggcagggguacgccacccagacggucggccccuggcaccucgggaagcuggagaucgacuucggcgagugccccggcaccaccgugaccauccaggagaacugcgaccaccgcgggcccucccugcgcacgaccaccgccagcggcaagcucgugacccaguggugcugccggagcugcacgaugccgccccugcgcuuccugggggaggacggcugcugguacgggauggagauccggccccucuccgagaaggaggagaacauggucaagagccaggugaccgccggccagggcaccuccgagaccuucagcauggggcugcugugccucacgcuguucgucgaggagugccugcgccggcgcgugacccggaagcacaugauccucgcgguggucaucacccugugcgccaucauccugggcgggcucaccuggauggaccugcugcgcgcccucaucaugcugggcgacacgauguccggccggaucgggggccagacccaccuggccaucaucgccguguucaagaugagccccggguacgugcucggcgucuuccugcgcaagcugaccucccgggagaccgcgcucauggugaucgggauggccaugacgaccacccugagcaucccgcacgaccugauggagcucaucgacggcaucucccugggccugauccuccugaagaucgugacccaguucgacaacacgcaggucgggacccuggcccucagccugaccuucauccgcuccaccaugagccuggugauggccuggcggacgaucauggccgugcucuucgucgugacccugaucccccugugccgcaccuccugccuccagaagcagagccacuggguggagaucaccgcgcugauccugggcgcccaggcccuccccgucuaccugaugacgcugaugaagggggccucccggcgcagcuggccccucaacgagggcaucauggcgguggggcuggugucccugcucggcagcgcccugcugaagaacgacgucccgcucgccggccccaugguggccgggggccugcugcucgccgcguacgugauguccgggagcagcgccgaccugucccuggagaaggccgccaacguccagugggacgagauggccgacaucaccggcagcucccccaucaucgaggugaagcaggacgaggacgggagcuucuccauccgggacguggaggagaccaacaugaucacccuccuggucaagcuggcgcucaucacggugagcggccuguacccccuggccaucccgaucaccaugacccucugguacauguggcaggugaagacccagcgcuccggcgcccugugggacguccccagccccgccgccacccagaaggcggcccuguccgaggggguguaccggaucaugcagcgcggccucuucgggaagacgcaggugggcgucgggauccacauggagggcguguuccacaccauguggcacgugacccggggcagcgucaucugccacgagaccgggcgccuggagcccuccugggccgacgugcgcaacgacaugaucagcuacggcgggggcuggcggcugggcgacaagugggaccgcgaggaggacgugcagguccucgccaucgagccggggaagaaccccaagcacgugcagacgaagcccggccuguucaagacccugaccggggagaucggcgccgugacccucgacuucaagcccgggacguccggcagcccgaucaucaaccggaagggcaaggucaucgggcuguacggcaacgggguggugaccaaguccggcgacuacgucagcgcgaucacccaggccgagcgcaucggggagcccgacuacgagguggacgaggacaucuuccggaagaagcgccugaccaucauggaccuccaccccggcgccggcaagacgaagcggauccugccguccaucgugcgcgaggcccugaagcggcgccugcggacccucauccuggcgcccacccgcgucguggccgccgagauggaggaggcccugcgggggcuccccauccgcuaccagacccccgccgugaagagcgagcacacgggccgggagaucgucgaccugaugugccacgcgaccuucaccacccgccugcucuccagcacgcgggugccgaacuacaaccugaucgugauggacgaggcccacuucaccgaccccagcuccgucgccgcccgcggguacaucagcacccggguggagaugggcgaggccgcggccaucuucaugaccgccacgccccccggggccaccgacccguucccccaguccaacagccccaucgaggacaucgagcgcgagauccccgagcgcuccuggaacaccggcuucgacuggaucaccgacuaccagggcaagacggucugguucgugccgagcaucaaggccgggaacgacaucgcgaacugccugcggaaguccggcaagaaggugauccagcucagccgcaagaccuucgacaccgaguaccccaagaccaagcugacggacugggacuucgucgugaccaccgacaucuccgagaugggggccaacuuccgggccggccgcgugaucgacccccggcgcugccugaagcccgucauccucaccgacgggccggagcgggugauccuggccggccccauccccgugacgcccgcgagcgccgcccagcgccggggccgcaucgggcggaacccggcccaggaggacgaccaguacgucuucuccggcgacccccugaagaacgacgaggaccacgcccacuggaccgaggcgaagaugcuccuggacaacaucuacacccccgaggggaucauccccacccuguucggcccggagcgcgagaagacgcaggccaucgacggcgaguuccggcuccgcggggagcagcggaagaccuucguggagcugaugcgccggggcgaccugcccguguggcucagcuacaaggucgccuccgccgggaucagcuacaaggaccgcgaguggugcuucaccggcgagcggaacaaccagauccuggaggagaacauggagguggagaucuggacccgcgagggggagaagaagaagcugcggcccaaguggcucgacgcccgcguguacgcggaccccauggcccugaaggacuucaaggaguucgccuccggccgcaagagcaucacccuggacauccucacggagaucgccucccugccgaccuaccugagcucccgggccaagcucgcgcuggacaacaucgucaugcugcacaccaccgagcgcggcgggcgggccuaccagcacgcccucaacgagcugcccgagagccuggagacgcucaugcugguggcccugcucggcgcgaugaccgccgggaucuuccuguucuucaugcagggcaaggggaucggcaagcugagcaugggccucaucaccaucgccguggccuccgggcugcugugggucgccgagauccagccccaguggaucgcggccagcaucauccucgaguucuuccugauggugcugcucaucccggagcccgagaagcagcgcaccccccaggacaaccagcugaucuacgugauccugacgauccucaccaucaucggccugaucgccgccaacgagauggggcugaucgagaagaccaagaccgacuucggcuucuaccaggucaagacggagaccaccauccucgacguggaccugcggcccgccuccgcguggacccuguacgccguggccacgaccauccucaccccgaugcugcgccacaccaucgagaacacgagcgccaaccugucccucgccgcgaucgccaaccaggccgccguccugauggggcugggcaagggcuggccccuccaccggauggaccugggggugccccugcucgccaugggcugcuacagccaggugaaccccaccacccugaccgcgucccuggucaugcuccuggugcacuacgccaucaucgggccgggccugcaggccaaggccacgcgcgaggcgcagaagcggaccgccgccggcaucaugaagaaccccaccguggacgggaucaccgucaucgaccucgagcccaucagcuacgaccccaaguucgagaagcagcugggccaggugaugcugcucgugcugugcgccgggcagcugcuccugaugcgcacgaccugggccuucugcgagguccugacccucgcgaccggcccgauccugacgcugugggaggggaaccccggccgguucuggaacaccaccaucgccguguccaccgccaacaucuuccgcggcagcuaccucgccggggccggccuggcguucucccugaucaagaacgcccagacgccccggcgcgggaccggcaccgccggggagacccucggcgagaaguggaagcggcagcugaacagccuggaccgcaaggaguucgaggaguacaagcgguccggcauccucgagguggaccgcaccgaggccaagagcgcccugaaggacggguccaagaucaagcacgcggucagccggggcuccagcaagauccgcuggaucguggagcgcgggauggugaagcccaagggcaaggucguggaccuggggugcggccggggcgggugguccuacuacauggccacgcucaagaacgugaccgaggucaagggcuacaccaaggggggcccggggcacgaggagcccauccccauggccaccuacggcuggaaccuggugaagcugcacagcggcguggacgucuucuacaagcccacggagcagguggacacccuccugugcgacaucggggagagcuccagcaacccgaccaucgaggagggccgcacccugcgggugcucaagauggucgagcccuggcuguccagcaagcccgaguucugcaucaaggugcugaaccccuacaugccgacggugaucgaggagcuggagaagcuccagcgcaagcacgggggcaaccugguccggugcccccugucccgcaacagcacccacgagauguacuggguguccggcgccagcgggaacaucgucuccagcgugaacaccaccuccaagaugcuccugaaccgguucacgacccgccaccggaagcccaccuacgagaaggacguggaccugggcgcggggacccgcagcgucuccacggagaucgagaagcccgacaugaccaucaucggccggcgccuccagcggcugcaggaggagcacaaggagaccuggcacuacgaccaggagaacccguaccgcaccugggccuaccacgggagcuacgaggcccccuccacgggcagcgccuccagcauggugaacggcguggucaagcugcucaccaagcccugggacgugaucccgauggugacccagcuggccaugaccgacacgacccccuucgggcagcagcgggucuucaaggagaagguggacacccgcaccccccagcccaagccgggcacgcggauggugaugaccaccaccgcgaacuggcugugggcccuccuggggaagaagaagaacccccgccugugcacgcgggaggaguucaucuccaagguccgcagcaacgccgccaucggcgccguguuccaggaggagcagggguggaccagcgcguccgaggccgugaacgacagccgguucugggagcucgucgacaaggagcgcgcccugcaccaggagggcaagugcgaguccugcguguacaacaugaugggcaagcgcgagaagaagcugggggaguucggccgggccaaggggagccgcgccaucugguacauguggcucggcgcgcgguuccuggaguucgaggcccugggguuccucaacgaggaccacugguucggccgcgagaacuccuggagcggcguggagggggagggccugcaccggcugggguacauccucgaggagaucgacaagaaggacggcgaccugauguacgccgacgacaccgccggcugggacacccgcaucacggaggacgaccugcagaacgaggagcucaucaccgagcagauggcgccccaccacaagauccuggccaaggccaucuucaagcugaccuaccagaacaaggucgugaaggugcuccggcccaccccgcgcggggccgucauggacaucaucucccggaaggaccagcgcggcagcgggcaggugggcaccuacgggcugaacacguucaccaacauggaggugcagcugauccggcagauggaggccgagggcgucaucacccaggacgacaugcagaaccccaagggccucaaggagcgcguggagaaguggcugcgggagugcgggguggaccgccugaagcggauggcgaucuccggcgacgacugcgucgugaagccccucgacgagcgcuucgggaccagccugcuguuccucaacgacaugggcaaggugcggaaggacaucccccagugggagccguccaagggguggaagaacuggcaggagguccccuucugcagccaccacuuccacaagaucuucaugaaggacggccgcucccugguggugcccugccggaaccaggacgagcugaucggccgcgcccgcaucagccagggggccggcuggucccuccgggagacggccugccuggggaaggccuacgcgcagauguggagccugauguacuuccaccgccgggaccuccgccuggccuccauggccaucugcagcgccguccccaccgagugguucccgaccagccggaccacgugguccauccacgcccaccaccaguggaugaccaccgaggacaugcugaagguguggaaccgcguguggaucgaggacaaccccaacaugaucgacaagacccccguccacagcugggaggacauccccuaccucggcaagcgggaggaccuguggugcgggucccugaucggccucagcucccgcgcgacgugggccaagaacauccacaccgccaucacccaggugcggaaccugaucggcaaggaggaguacguggacuacaugagcgucaugaagcgcuacuccgccccgagcgaguccgagggggugcuguga

SEQ ID NO: 10421 - RNA, 9867 nt, Artificial Sequence
  derived and/or modified CDS sequence (opt1) from DENV-4__KP188564__SS-prME
agcaccaucacccugcucugccugauccccacggugauggccuuccaccuguccacccgcgacggcgagccgcucaugaucgucgccaagcacgagcgggggcgcccccugcuguucaagaccaccgagggcaucaacaagugcacgcucaucgcgauggaccugggggagaugugcgaggacaccgugaccuacaagugcccccugcucgugaacaccgagcccgaggacaucgacugcuggugcaaccugacgagcaccugggucauguacggcaccugcacccaguccggggagcggcgccgggagaagcgcagcguggcccugacgccgcacuccggcaugggccucgagacccgggccgagaccuggaugagcuccgagggggccuggaagcacgcccagcgcguggagagcuggauccugcggaaccccggcuucgcgcugcucgccggguucauggccuacaugaucggccagaccgggauccagcgcacggucuucuucgugcugaugaugcugguggcccccuccuacggcaugcggugcgucggcguggggaaccgcgacuucguggagggcgucagcgggggcgcguggguggaccucgugcuggagcacggcgggugcgucaccaccaucgcccagggcaagcccacccuggacuucgagcucacgaagaccaccgccaaggagguggcccugcugcggaccuacugcaucgaggcccucaucuccaacaucacgaccgcgacccgcugcccgacccagggggagcccuaccugaaggaggagcaggaccagcaguacaucugccggcgcgacguggucgaccggggcugggggaacggcugcggccuguucgggaagggcgggguggugacgugcgccaaguucagcugcuccggcaagaucaccgggaaccucguccagaucgagaaccuggaguacaccgugguggucaccgugcacaacggcgacacgcacgccgucggcaacgacaccagcaaccacggggugaccgccaccaucacgccccgcucccccagcguggaggucaagcugccggacuacggcgagcucacccuggacugcgagccccgguccgggaucgacuucaacgagaugauccugaugaagaugaagaagaagaccuggcucgugcacaagcagugguuccuggaccugccccuccccuggaccaccggcgccgacacgagcgaggugcacuggaacuacaaggagcgcauggucaccuucaaggugccgcacgcgaagcggcaggacgugaccguccuggggucccaggagggcgccaugcacagcgcccuggccggcgccaccgagguggacagcggggacggcaaccacauguucgcggggcaccucaagugcaaggugcgcauggagaagcugcgcaucaagggcauguccuacacgaugugcagcggcaaguucuccaucgacaaggagauggccgagacccagcacgggaccaccgucgugaagaucaaguacgagggcgccggggcccccugcaaggugcccaucgagauccgggacgucaacaaggagaagguggugggccgcgucaucagcgccacgccccuggcggagaacaccaacuccgugaccaacaucgagcucgagccgcccuucggggacagcuacaucgugaucggcgucggcaacuccgcccugacccugcacugguuccggaaggggagcuccaucggcaagauguucgagagcacguaccgcggggccaagcggauggccauccucggcgagaccgcgugggacuucggguccgugggcggccuguucaccagccuggggaaggccgugcaccaggucuucggcuccguguacaccacgauguucgggggcgugagcuggaugauccgcauccucaucggguuccugguccuguggaucggcaccaacucccggaacaccagcauggccaugaccugcaucgccgugggcgggaucacgcuguuccucggcuucaccgugcaggccgacauggggugcgucguguccuggagcggccgcgagcugaagugcggguccggcaucuucguggucgacaacgugcacaccuggaccgagcaguacaaguuccagcccgagagccccgcgcggcuggccagcgccauccucaacgcccacaaggacggcgugugcgggauccgcuccacgacccggcuggagaacgucauguggaagcagaucaccaacgagcugaacuacgugcucugggagggcgggcacgaccugaccguggucgccggcgacgugaagggcgugcugacgaaggggaagcgcgcgcucaccccgcccgccagcgaccugaaguacuccuggaagaccuggggcaaggccaagaucuucacccccgaggcccggaacagcacguuccugaucgacgggcccgacaccuccgagugcccgaacgagcgccgggccuggaacagcuucgaggucgaggacuacggcuucgggauguucaccaccaacaucuggaugaaguuccgcgagggcuccagcgaggugugcgaccaccggcucauguccgcggccaucaaggaccagaaggccgugcacgccgacaugggcuacuggaucgagagcuccaagaaccagacguggcagaucgagcgcgcgagccugaucgaggucaagaccugccuguggcccaagacccacacccucugguccaacggggugcuggagagccagaugcugauccccaaguccuacgccggcccguucagccagcacaacuaccggcagggguacgccacccagacggugggccccuggcaccucgggaagcuggagaucgacuucggcgagugccccggcaccaccgucaccauccaggagaacugcgaccaccgcgggcccucccugcgcacgaccaccgccagcggcaagcucgugacccaguggugcugccggagcugcacgaugccgccccugcgcuuccugggggaggacggcugcugguacgggauggagauccggccccucuccgagaaggaggagaacauggugaagagccaggucaccgccggccagggcaccuccgagaccuucagcauggggcugcugugccucacgcuguucguggaggagugccugcgccggcgcgucacccggaagcacaugauccucgcgguggugaucacccugugcgccaucauccugggcgggcucaccuggauggaccugcugcgcgcccucaucaugcugggcgacacgauguccggccggaucgggggccagacccaccuggccaucauggccgucuucaagaugagccccggguacgugcucggcguguuccugcgcaagcugaccucccgggagaccgcgcucauggucaucgggauggccaugacgaccacccugagcaucccgcacgaccugauggagcucaucgacggcaucucccugggccugauccuccugaagaucgugacccaguucgacaacacgcagguggggacccuggcccucagccugaccuucauccgcuccaccaugagccuggucauggccuggcggacgaucauggccgugcucuucguggucacccugaucccccugugccgcaccuccugccuccagaagcagagccacuggguggagaucaccgcgcugauccugggcgcccaggcccuccccguguaccugaugacgcugaugaagggggccucccggcgcagcuggccccucaacgagggcaucauggcggucgggcuggugucccugcucggcagcgcccugcugaagaacgacgugccgcucgccggccccauggucgccgggggccugcugcucgccgcguacgugauguccgggagcagcgccgaccugucccuggagaaggccgccaacgugcagugggacgagauggccgacaucaccggcagcucccccaucaucgaggucaagcaggacgaggacgggagcuucuccauccgggacguggaggagaccaacaugaucacccuccuggugaagcuggcgcucaucacggucagcggccuguacccccuggccaucccgaucaccaugacccucugguacauguggcaggugaagacccagcgcuccggcgcccugugggacgugcccagccccgccgccacccagaaggcggcccuguccgagggggucuaccggaucaugcagcgcggccucuucgggaagacgcaggugggcguggggauccacauggagggcgucuuccacaccauguggcacgugacccggggcagcgugaucugccacgagaccgggcgccuggagcccuccugggccgacguccgcaacgacaugaucagcuacggcgggggcuggcggcugggcgacaagugggacaaggaggaggacgugcaggugcucgccaucgagccggggaagaaccccaagcacguccagacgaagcccggccuguucaagacccugaccggggagaucggcgccgugacccucgacuucaagcccgggacguccggcagcccgaucaucaaccgcaagggcaaggugaucgggcuguacggcaacggggucgugaccaaguccggcgacuacgugagcgcgaucacccaggccgagcggaucggggagcccgacuacgaggucgacgaggacaucuuccgcaagaagcggcugaccaucauggaccuccaccccggcgccggcaagacgaagcgcauccugccguccaucgugcgggaggcccugaagcgccggcugcgcacccucauccuggcgcccacccggguggucgccgccgagauggaggaggcccugcgcgggcuccccauccgguaccagacccccgccgugaagagcgagcacacgggccgcgagaucguggaccugaugugccacgcgaccuucaccacccggcugcucuccagcacgcgcgucccgaacuacaaccugaucgugauggacgaggcccacuucaccgaccccagcuccguggccgcccggggguacaucagcacccgcgucgagaugggcgaggccgcggccaucuucaugaccgccacgccccccggggccaccgacccguucccccaguccaacagccccaucgaggacaucgagcgggagauccccgagcgcuccuggaacaccggcuucgacuggaucaccgacuaccagggcaagacggugugguucgucccgagcaucaaggccgggaacgacaucgcgaacugccugcgcaaguccggcaagaaggugauccagcucagccggaagaccuucgacaccgaguaccccaagaccaagcugacggacugggacuucguggucaccaccgacaucuccgagaugggggccaacuuccgcgccggccgggugaucgacccccgccggugccugaagcccgugauccucaccgacgggccggagcgcgucauccuggccggccccauccccgugacgcccgcgagcgccgcccagcggcgcggccggaucgggcgcaacccggcccaggaggacgaccaguacguguucuccggcgacccccugaagaacgacgaggaccacgcccacuggaccgaggcgaagaugcuccuggacaacaucuacacccccgaggggaucauccccacccuguucggcccggagcgggagaagacgcaggccaucgacggcgaguuccgccuccggggggagcagcgcaagaccuucgucgagcugaugcggcgcggcgaccugcccguguggcucagcuacaagguggccuccgccgggaucagcuacaaggaccgggaguggugcuucaccggcgagcgcaacaaccagauccuggaggagaacauggaggucgagaucuggacccgggagggggagaagaagaagcugcgccccaaguggcucgacgcccggguguacgcggaccccauggcccugaaggacuucaaggaguucgccuccggccgcaagagcaucacccuggacauccucacggagaucgccucccugccgaccuaccugagcucccgcgccaagcucgcgcuggacaacaucgugaugcugcacaccaccgagcggggcgggcgcgccuaccagcacgcccucaacgagcugcccgagagccuggagacgcucaugcuggucgcccugcucggcgcgaugaccgccgggaucuuccuguucuucaugcagggcaaggggaucggcaagcugagcaugggccucaucaccaucgccguggccuccgggcugcuguggguggccgagauccagccccaguggaucgcggccagcaucauccucgaguucuuccugaugguccugcucaucccggagcccgagaagcagcggaccccccaggacaaccagcugaucuacgugauccugacgauccucaccaucaucggccugaucgccgccaacgagauggggcugaucgagaagaccaagaccgacuucggcuucuaccaggugaagacggagaccaccauccucgacgucgaccugcgccccgccuccgcguggacccuguacgccguggccacgaccauccucaccccgaugcugcggcacaccaucgagaacacgagcgccaaccugucccucgccgcgaucgccaaccaggccgccgugcugauggggcugggcaagggcuggccccuccaccgcauggaccugggggucccccugcucgccaugggcugcuacagccaggugaaccccaccacccugaccgcgucccuggugaugcuccugguccacuacgccaucaucgggccgggccugcaggccaaggccacgcgggaggcgcagaagcgcaccgccgccggcaucaugaagaaccccaccguggacgggaucaccgugaucgaccucgagcccaucagcuacgaccccaaguucgagaagcagcugggccaggucaugcugcucgugcugugcgccgggcagcugcuccugaugcggacgaccugggccuucugcgaggugcugacccucgcgaccggcccgacgcugacccugugggaggggaaccccggccgcuucuggaacaccaccaucgccgucuccacggccaacaucuuccggggcagcuaccucgccggggccggccuggcguucucccugaucaagaacgcccagaccccccgccgggggaccggcaccgccggggagacccucggcgagaaguggaagcgccagcugaacagccuggaccggaaggaguucgaggaguacaagcgcuccggcauccucgagguggaccggacggaggccaagagcgcccugaaggacggguccaagaucaagcacgcggugagccgcggcuccagcaagauccgguggaucgucgagcgcgggauggugaagcccaagggcaagguggucgaccuggggugcggccgcggcgggugguccuacuacauggccacccucaagaacgugaccgaggugaagggcuacaccaaggggggcccggggcacgaggagcccauccccauggccacguacggcuggaaccuggucaagcugcacagcggcguggacguguucuacaagcccaccgagcaggucgacacccuccugugcgacaucggggagagcuccagcaacccgaccaucgaggagggccggacgcugcgcgugcucaagaugguggagcccuggcuguccagcaagcccgaguucugcaucaagguccugaaccccuacaugccgaccgugaucgaggagcuggagaagcuccagcggaagcacgggggcaaccuggugcgcugcccccugucccggaacagcacccacgagauguacugggucuccggcgccagcgggaacaucguguccagcgucaacaccacguccaagaugcuccugaaccgcuucaccacccggcaccgcaagcccaccuacgagaaggacguggaccugggcgcggggacgcggagcguguccaccgagaccgagaagcccgacaugaccaucaucggccgccggcuccagcgccugcaggaggagcacaaggagacguggcacuacgaccaggagaacccguaccggaccugggccuaccacgggagcuacgaggcccccuccaccggcagcgccuccagcauggucaacggcguggugaagcugcucaccaagcccugggacgucaucccgauggugacgcagcuggccaugaccgacaccacccccuucgggcagcagcgcguguucaaggagaaggucgacacgcggaccccccagcccaagccgggcacccgcauggugaugaccacgaccgcgaacuggcugugggcccuccuggggaagaagaagaacccccggcugugcacccgcgaggaguucaucuccaaggugcggagcaacgccgccaucggcgccgucuuccaggaggagcagggguggaccagcgcgaacgaggccgugaacgacucccgcuucugggagcucguggacaaggagcgggcccugcaccaggagggcaagugcgagagcugcgucuacaacaugaugggcaagcgcgagaagaagcugggggaguucggccgcgccaaggggucccgggccaucugguacauguggcucggcgcgcgcuuccuggaguucgaggcccugggguuccucaacgaggaccacugguucggccgggagaacagcugguccggcguggagggggagggccugcaccgccugggguacauccucgaggagaucgacaagaaggacggcgaccugauguacgccgacgacacggccggcugggacacccggaucaccgaggacgaccugcagaacgaggagcucaucaccgagcagauggcgccccaccacaagauccuggccaaggccaucuucaagcugaccuaccagaacaagguggucaaggugcuccgccccacgccgcggggggccgugauggacaucaucagccgcaaggaccagcggggcuccgggcaggucggcaccuacgggcugaacaccuucaccaacauggaggugcagcugauccgccagauggaggccgagggcgugaucacgcaggacgacaugcagaaccccaagggccucaaggagcgggucgagaaguggcugcgcgagugcgggguggaccggcugaagcgcauggcgaucagcggcgacgacugcguggucaagccccucgacgagcgguucgggaccucccugcuguuccucaacgacaugggcaaggugcgcaaggacaucccccagugggagccgagcaagggguggaagaacuggcaggaggugcccuucugcucccaccacuuccacaagaucuucaugaaggacggccggagccuggucgugcccugccgcaaccaggacgagcugaucggccgggcccgcaucucccagggggccggcuggagccuccgcgagaccgccugccuggggaaggccuacgcgcagauguggucccugauguacuuccaccggcgcgaccuccggcuggccagcauggccaucugcuccgccgugcccaccgagugguucccgacgagccgcaccaccuggagcauccacgcccaccaccaguggaugaccacggaggacaugcugaaggucuggaaccggguguggaucgaggacaaccccaacaugaucgacaagacccccgugcacuccugggaggacauccccuaccucggcaagcgcgaggaccuguggugcgggagccugaucggccucuccagccgggcgaccugggccaagaacauccacaccgccaucacgcagguccgcaaccugaucggcaaggaggaguacguggacuacaugccggugaugaagcgguacuccgcccccagcgaguccgaggggguccuguga

SEQ ID NO: 10422 - RNA, 9867 nt, Artificial Sequence
  derived and/or modified CDS sequence (opt1) from DENV-4__JN983813__SS-prME
agcaccaucacccugcucugccugauccccacggugauggccuuccaccuguccacccgcgacggcgagccgcucaugaucgucgccaagcacgagcgggggcgcccccugcuguucaagaccaccgagggcaucaacaagugcacgcucaucgcgauggaccugggggagaugugcgaggacaccgugaccuacaagugcccccugcucgugaacaccgagcccgaggacaucgacugcuggugcaaccugacgagcaccugggucauguacggcaccugcacccaguccggggagcggcgccgggagaagcgcagcguggcccugacgccgcacuccggcaugggccucgagacccgggccgagaccuggaugagcuccgagggggccuggaagcacgcccagcgcguggagagcuggauccugcggaaccccggcuucgcgcugcucgccggguucauggccuacaugaucggccagaccgggauccagcgcacggucuucuucgugcugaugaugcugguggcccccuccuacggcaugcggugcgucggcguggggaaccgcgacuucguggagggcgucagcgggggcgcguggguggaccucgugcuggagcacggcgggugcgucaccaccauggcccagggcaagcccacccuggacuucgagcucacgaagaccaccgccaaggagguggcccugcugcggaccuacugcaucgaggcccucaucuccaacaucacgaccgcgacccgcugcccgacccagggggagcccuaccugaaggaggagcaggaccagcaguacaucugccggcgcgacguggucgaccggggcugggggaacggcugcggccuguucgggaagggcgggguggugacgugcgccaaguucagcugcuccggcaagaucaccgggaaccucguccagaucgagaaccuggaguacaccgugguggucaccgugcacaacggcgacacgcacgccgucggcaacgacaccagcaaccacggggugaccgccaccaucacgccccgcucccccagcguggaggucaagcugccggacuacggcgagcucacccuggacugcgagccccgguccgggaucgacuucaacgagaugauccugaugaagaugaagaagaagaccuggcucgugcacaagcagugguuccuggaccugccccuccccuggaccaccggcgccgacacgagcgaggugcacuggaacuacaaggagcgcauggucaccuucaaggugccgcacgcgaagcggcaggacgugaccguccuggggucccaggagggcgccaugcacagcgcccuggccggcgccaccgagguggacagcggggacggcaaccacauguucgcggggcaccucaagugcaaggugcgcauggagaagcugcgcaucaagggcauguccuacacgaugugcagcggcaaguucuccaucgacaaggagauggccgagacccagcacgggaccaccgucgugaaggugaaguacgagggcgccggggcccccugcaagguccccaucgagauccgggacgugaacaaggagaagguggucggccgcgugaucagcgccacgccccuggcggagaacaccaacuccgugaccaacaucgagcucgagccgcccuucggggacagcuacaucgucaucggcgugggcaacuccgcccugacccugcacugguuccggaaggggagcuccaucggcaagauguucgagagcacguaccgcggggccaagcggauggccauccucggcgagaccgcgugggacuucggguccgugggcggccuguucaccagccuggggaaggccguccaccagguguucggcuccguguacaccacgauguucgggggcgucagcuggaugauccgcauccucaucggguuccuggugcuguggaucggcaccaacucccggaacaccagcauggccaugaccugcaucgccgugggcgggaucacgcuguuccucggcuucaccguccaggccgacauggggugcgugguguccuggagcggccgcgagcugaagugcggguccggcaucuucgucguggacaacgugcacaccuggaccgagcaguacaaguuccagcccgagagccccgcgcggcuggccagcgccauccucaacgcccacaaggacggcgucugcgggauccgcuccacgacccggcuggagaacgugauguggaagcagaucaccaacgagcugaacuacgugcucugggagggcgggcacgaccugaccgucguggccggcgacgugaagggcguccugacgaaggggaagcgcgcgcucaccccgcccgccagcgaccugaaguacuccuggaagaccuggggcaaggccaagaucuucacccccgaggcccggaacagcacguuccugaucgacgggcccgacaccuccgagugcccgaacgagcgccgggccuggaacagcuucgagguggaggacuacggcuucgggauguucaccaccaacaucuggaugaaguuccgcgagggcuccagcgaggugugcgaccaccggcucauguccgcggccaucaaggaccagaaggccguccacgccgacaugggcuacuggaucgagagcuccaagaaccagacguggcagaucgagcgcgcgagccugaucgaggugaagaccugccuguggcccaagacccacacccucugguccaacggggugcuggagagccagaugcugauccccaaguccuacgccggcccguucagccagcacaacuaccggcagggguacgccacccagacggucggccccuggcaccucgggaagcuggagaucgacuucggcgagugccccggcaccaccgugaccauccaggagaacugcgaccaccgcgggcccucccugcgcacgaccaccgccagcggcaagcucgugacccaguggugcugccggagcugcacgaugccgccccugcgcuuccugggggaggacggcugcugguacgggauggagauccggccccucuccgagaaggaggagaacauggucaagagccaggugaccgccggccagggcaccuccgagaccuucagcauggggcugcugugccucacgcuguucgucgaggagugccugcgccggcgcgugacccggaagcacaugauccucgcgguggucaucacccugugcgccaucauccugggcgggcucaccuggauggaccugcugcgcgcccucaucaugcugggcgacacgauguccggccggaucgggggccagacccaccuggccaucauggccguguucaagaugagccccggguacgugcucggcgucuuccugcgcaagcugaccucccgggagaccgcgcucauggugaucgggauggccaugacgaccacccugagcaucccgcacgaccugauggagcucaucgacggcaucucccugggccugauccuccugaagaucgugacccaguucgacaacacgcaggucgggacccuggcccucagccugaccuucauccgcuccaccaugagccuggugauggccuggcggacgaucauggccgugcucuucgucgugacccugaucccccugugccgcaccuccugccuccagaagcagagccacuggguggagaucaccgcgcugauccugggcgcccaggcccuccccgucuaccugaugacgcugaugaagggggccucccggcgcagcuggccccucaacgagggcaucauggcgguggggcuggugucccugcucggcagcgcccugcugaagaacgacgucccgcucgccggccccaugguggccgggggccugcugcucgccgcguacgugauguccgggagcagcgccgaccugucccuggagaaggccgccaacguccagugggacgagauggccgacaucaccggcagcucccccaucaucgaggugaagcaggacgaggacgggagcuucuccauccgggacguggaggagaccaacaugaucacccuccuggucaagcuggcgcucaucacggugagcggccuguacccccuggccaucccgaucaccaugacccucugguacauguggcaggugaagacccagcgcuccggcgcccugugggacguccccagccccgccgccacccagaaggcggcccuguccgaggggguguaccggaucaugcagcgcggccucuucgggaagacgcaggugggcgucgggauccacauggagggcguguuccacaccauguggcacgugacccggggcagcgucaucugccacgagaccgggcgccuggagcccuccugggccgacgugcgcaacgacaugaucagcuacggcgggggcuggcggcugggcgacaagugggacaaggaggaggacgugcagguccucgccaucgagccggggaagaaccccaagcacgugcagacgaagcccggccuguucaagacccugaccggggagaucggcgccgugacccucgacuucaagcccgggacguccggcagcccgaucaucaaccgcaagggcaaggucaucgggcuguacggcaacgggguggugaccaaguccggcgacuacaucagcgcgaucacccaggccgagcggaucggggagcccgacuacgaggucgacgaggacaucuuccgcaagaagcggcugaccaucauggaccuccaccccggcgccggcaagacgaagcgcauccugccguccaucgugcgggaggcccugaagcgccggcugcgcacccucauccuggcgcccacccggguggucgccgccgagauggaggaggcccugcgcgggcuccccauccgguaccagacccccgccgugaagagcgagcacacgggccgcgagaucguggaccugaugugccacgcgaccuucaccacccggcugcucuccagcacgcgcgucccgaacuacaaccugaucgugauggacgaggcccacuucaccgaccccagcuccguggccgcccggggguacaucagcacccgcgucgagaugggcgaggccgcggccaucuucaugaccgccacgccccccggggccaccgacccguucccccaguccaacagccccaucgaggacaucgagcgggagauccccgagcgcuccuggaacaccggcuucgacuggaucaccgacuaccagggcaagacggugugguucgucccgagcaucaaggccgggaacgacaucgcgaacugccugcgcaaguccggcaagaaggugauccagcucagccggaagaccuucgacaccgaguaccccaagaccaagcugacggacugggacuucguggucaccaccgacaucuccgagaugggggccaacuuccgcgccggccgggugaucgacccccgccggugccugaagcccgugauccucaccgacgggccggagcgcgucauccuggccggccccauccccgugacgcccgcgagcgccgcccagcggcgcggccggaucgggcgcaacccggcccaggaggacgaccaguacguguucuccggcgacccccugaagaacgacgaggaccacgcccacuggaccgaggcgaagaugcuccuggacaacaucuacacccccgaggggaucauccccacccuguucggcccggagcgggagaagacgcaggccaucgacggcgaguuccgccuccggggggagcagcgcaagaccuucgucgagcugaugcggcgcggcgaccugcccguguggcucagcuacaagguggccuccgccgggaucagcuacaaggaccgggaguggugcuucaccggcgagcgcaacaaccagauccuggaggagaacauggaggucgagaucuggacccgggagggggagaagaagaagcugcgccccaaguggcucgacgcccggguguacgcggaccccauggcccugaaggacuucaaggaguucgccuccggccgcaagagcaucacccuggacauccucacggagaucgccucccugccgaccuaccugagcucccgcgccaagcucgcgcuggacaacaucgugaugcugcacaccaccgagcggggcgggcgcgccuaccagcacgcccucaacgagcugcccgagagccuggagacgcucaugcuggucgcccugcucggcgcgaugaccgccgggaucuuccuguucuucaugcagggcaaggggaucggcaagcugagcaugggccucaucaccaucgccguggccuccgggcugcuguggguggccgagauccagccccaguggaucgcggccagcaucauccucgaguucuuccugaugguccugcucaucccggagcccgagaagcagcggaccccccaggacaaccagcugaucuacgugauccugacgauccucaccaucaucggccugaucgccgccaacgagauggggcugaucgagaagaccaagaccgacuucggcuucuaccaggugaagacggagaccaccauccucgacgucgaccugcgccccgccuccgcguggacccuguacgccguggccacgaccauccucaccccgaugcugcggcacaccaucgagaacacgagcgccaaccugucccucgccgcgaucgccaaccaggccgccgugcugauggggcugggcaagggcuggccccuccaccgcauggaccugggggucccccugcucgccaugggcugcuacagccaggugaaccccaccacccugaccgcgucccuggugaugcuccugguccacuacgccaucaucgggccgggccugcaggccaaggccacgcgggaggcgcagaagcgcaccgccgccggcaucaugaagaaccccaccguggacgggaucaccgugaucgaccucgagcccaucagcuacgaccccaaguucgagaagcagcugggccaggucaugcugcucgugcugugcgccgggcagcugcuccugaugcggacgaccugggccuucugcgaggugcugacccucgcgaccggcccgauccugacgcugugggaggggaaccccggccgcuucuggaacaccaccaucgccgucuccaccgccaacaucuuccggggcagcuaccucgccggggccggccuggcguucucccugaucaagaacgcccagacgccccgccgggggaccggcaccgccggggagacccucggcgagaaguggaagcgccagcugaacagccuggaccggaaggaguucgaggaguacaagcgcuccggcauccucgagguggaccggaccgaggccaagagcgcccugaaggacggguccaagaucaagcacgcggugagccgcggcuccagcaagauccgguggaucgucgagcgcgggauggugaagcccaagggcaagguggucgaccuggggugcggccgcggcgggugguccuacuacauggccacgcucaagaacgugaccgaggugaagggcuacaccaaggggggcccggggcacgaggagcccauccccauggccaccuacggcuggaaccuggucaagcugcacagcggcguggacguguucuacaagcccacggagcaggucgacacccuccugugcgacaucggggagagcuccagcaacccgaccaucgaggagggccggacccugcgcgugcucaagaugguggagcccuggcuguccagcaagcccgaguucugcaucaagguccugaaccccuacaugccgacggugaucgaggagcuggagaagcuccagcggaagcacgggggcaaccuggugcgcugcccccugucccggaacagcacccacgagauguacugggucuccggcgccagcgggaacaucguguccagcgucaacaccaccuccaagaugcuccugaaccgcuucacgacccggcaccgcaagcccaccuacgagaaggacguggaccugggcgcggggacccggagcguguccacggagaccgagaagcccgacaugaccaucaucggccgccggcuccagcgccugcaggaggagcacaaggagaccuggcacuacgaccaggagaacccguaccggacgugggccuaccacgggagcuacgaggcccccuccaccggcagcgccuccagcauggucaacggcguggugaagcugcucaccaagcccugggacgucaucccgauggugacccagcuggccaugacggacaccacccccuucgggcagcagcgcguguucaaggagaaggucgacacccggacgccccagcccaagccgggcacccgcauggugaugaccaccacggcgaacuggcugugggcccuccuggggaagaagaagaacccccggcugugcacccgcgaggaguucaucuccaaggugcggagcaacgccgccaucggcgccgucuuccaggaggagcagggguggaccagcgcguccgaggccgugaacgacagccgcuucugggagcucguggacaaggagcgggcccugcaccaggagggcaagugcgaguccugcgucuacaacaugaugggcaagcgcgagaagaagcugggggaguucggccgcgccaaggggagccgggccaucugguacauguggcucggcgcgcgcuuccuggaguucgaggcccugggguuccucaacgaggaccacugguucggccgggagaacuccuggagcggcguggagggggagggccugcaccgccugggguacauccucgaggagaucgacaagaaggacggcgaccugauguacgccgacgacaccgccggcugggacacgcggaucaccgaggacgaccugcagaacgaggagcucaucaccgagcagauggcgccccaccacaagauccuggccaaggccaucuucaagcugaccuaccagaacaagguggucaaggugcuccgccccaccccgcggggggccgugauggacaucaucucccgcaaggaccagcggggcagcgggcaggucggcacguacgggcugaacaccuucaccaacauggaggugcagcugauccgccagauggaggccgagggcgugaucacccaggacgacaugcagaaccccaagggccucaaggagcgggucgagaaguggcugcgcgagugcgggguggaccggcugaagcgcauggcgaucuccggcgacgacugcguggucaagccccucgacgagcgguucgggacgagccugcuguuccucaacgacaugggcaaggugcgcaaggacaucccccagugggagccguccaagggguggaagaacuggcaggaggugcccuucugcagccaccacuuccacaagaucuucaugaaggacggccggucccuggucgugcccugccgcaaccaggacgagcugaucggccgggcccgcaucagccagggggccggcuggucccuccgcgagaccgccugccuggggaaggccuacgcgcagauguggagccugauguacuuccaccggcgcgaccuccggcuggccuccauggccaucugcagcgccgugcccaccgagugguucccgaccagccgcacgaccugguccauccacgcccaccaccaguggaugaccaccgaggacaugcugaaggucuggaaccggguguggaucgaggacaaccccaacaugaucgacaagacgcccgugcacagcugggaggacauccccuaccucggcaagcgcgaggaccuguggugcgggucccugaucggccucagcucccgggcgaccugggccaagaacauccacaccgccaucacccagguccgcaaccugaucggcaaggaggaguacguggacuacaugccggugaugaagcgguacagcgcccccuccgagagcgaggggguccuguga

SEQ ID NO: 10423 - RNA, 9867 nt, Artificial Sequence
  derived and/or modified CDS sequence (opt1) from DENV-4__KF041260__SS-prME
agcaccaucacccugcucugccugauccccacggugauggccuuccaccuguccacccgcgacggcgagccgcucaugaucgucgccaagcacgagcgggggcgcccccugcuguucaagaccaccgagggcaucaacaagugcacgcucaucgcgauggaccugggggagaugugcgaggacaccgugaccuacaagugcccccugcucgugaacaccgagcccgaggacaucgacugcuggugcaaccugacgagcgccugggucauguacggcaccugcacccaguccggggagcggcgccgggagaagcgcagcguggcccugaccccgcacuccggcaugggccucgagacgcgggccgagaccuggaugagcuccgagggggccuggaagcacgcgcagcgcguggagagcuggauccugcggaaccccggcuucgcccugcucgccggguucauggccuacaugaucggccagaccgggauccagcgcaccgucuucuucauccugaugaugcugguggcgcccuccuacggcaugcggugcgugggcgucgggaaccgcgacuucguggagggcgugagcgggggcgccugggucgaccucgugcuggagcacggcgggugcgugacgaccauggcccagggcaagcccacccuggacuucgagcucaucaagaccacggccaaggaggucgcccugcugcggaccuacugcaucgaggcguccaucagcaacaucaccaccgccacgcgcugcccgacccagggggagcccuaccucaaggaggagcaggaccagcaguacaucugccggcgcgacgugguggaccggggcugggggaacggcugcggccuguucgggaagggcggggucgugaccugcgccaaguucuccugcagcggcaagaucaccgggaaccugauccagaucgagaaccucgaguacacgguggucgugaccgugcacaacggcgacacccacgccgucggcaacgacaccuccaaccacggggugacggccaccgucaccccccgcagccccuccguggagguggagcugccggacuacggcgagcugacccucgacugcgagccccggagcgggaucgacuucaacgagaugauccugaugaagaugaacaagaagacguggcugguccacaagcagugguuccucgaccugccccugcccuggaccgcgggcgccgacaccuccgaggugcacuggaaccacaaggagcgcauggugaccuucaaggucccgcacgccaagcggcaggacgugaccgugcucgggagccaggagggcgccaugcacagcgcccugacgggcgcgaccgaggucgacuccggggacggcaaccacauguucgccgggcaccugaagugcaaggugcgcauggagaagcuccgcaucaagggcaugagcuacaccaugugcuccggcaaguucagcaucgacaaggagauggccgagacccagcacgggacgaccguggucaaggugaaguacgagggcgccggggcccccugcaaggugcccaucgagauccgggacgucaacaaggagaagguggugggccgcaucaucuccagcacccccuucgcggagaacaccaacuccgucacgaacaucgagcuggagccgcccuucggggacagcuacaucgugaucggcgugggcgacuccgcccugacccuccacugguuccggaaggggagcuccaucggcaagauguucgagagcaccuaccgcggggccaagcggauggccauccugggcgagaccgcgugggacuucggguccgucggcggccugcucacgagccuggggaaggccgugcaccagguguucggcuccgucuacaccaccauguucgggggcgugagcuggauggugcgcauccugaucggguuccucguccuguggaucggcaccaacucccggaacacgagcauggccauguccugcaucgccgugggcgggaucacccuguuccugggcuucaccgugcacgccgacauggggugcgcggucagcuggagcggcaaggagcucaagugcggguccggcaucuucaucaucgacaacgugcacaccuggacggagcaguacaaguuccagcccgagagccccgcccgccuggccuccgccauccugaacgcccacaaggacggcgugugcgggauccggagcaccacccgccucgagaacgucauguggaagcagaucaccaacgagcugaacuacgugcugugggagggcgggcacgaccucacgguggucgcgggcgacgugaagggcgugcuguccaaggggaagcgggcccuggccccgcccgucaacgaccucaaguacagcuggaagaccuggggcaaggccaagaucuucacccccgagacccgcaacuccacguuccugaucgacgggcccgacaccagcgagugcccgaacgagcggcgcgccuggaacuuccuggagguggaggacuacggcuucgggauguucaccaccaacaucuggaugaaguuccgggagggcuccagcgaggugugcgaccaccgccucauguccgcggccaucaaggaccagaaggccguccacgccgacaugggcuacuggaucgagagcuccaagaaccagacguggcagaucgagaaggcgagccugaucgaggugaagaccugccuguggcccaagacccacacccucugguccaacggggugcuggagagccagaugcugauccccaaggccuacgccggcccguucucccagcacaacuaccggcagggguacgccacgcagaccaugggccccuggcaccucgggaagcuggagaucgacuucggcgagugccccggcaccaccgucaccauccaggaggacugcgaccaccgcgggcccagccugcggacgaccaccgccagcggcaagcucgugacccaguggugcugccgcuccugcacgaugccgccccugcgcuuccugggggaggacggcugcugguacgggauggagauccggccccucagcgagaaggaggagaacauggugaagucccaggucagcgcgggccagggcaccuccgagaccuucagcauggggcugcugugccucacccuguucguggaggagugccugcgccggcgcgugacgcggaagcacaugauccucgucguggucaccacccugugcgccaucauccugggcgggcucaccuggauggaccugcugcgcgcccucaucaugcugggcaacacgauguccagccggaugggcgggcagacccaccuggccaucauggccguguucaagaugucccccggcuacgugcucgggaucuuccugcgcaagcugaccagccgggagaccgcgcucauggucaucggcauggccaugacgaccgugcuguccaucccgcacgaccugauggaguucaucgacgggaucagccucggccugauccugcucaagauggugacccacuucgacaacacccaggucggcacgcuggcccugucccucaccuucaucaagagcaccaugccccuggugauggccuggcgcaccaucauggccgugcuguucgucgugacgcucaucccccugugccggaccuccugccugcagaagcagagccacuggguggagaucaccgcgcucauccugggggcccaggcccugcccgucuaccucaugacccugaugaagggcgccuccaagcgcagcuggccgcugaacgaggggaucauggcggugggccucgugucccugcuggggagcgcccuccugaagaacgacgucccccuggccggccccaugguggccggcgggcuccugcuggccgcguacgugaugagcggcuccagcgccgaccucucccuggagaaggccgccacgguccagugggacgagauggccgacaucaccgggagcucccccaucaucgaggugaagcaggacgaggacggcagcuucuccauccgggacguggaggagaccaacaugaucacccugcucgucaagcuggcgcugaucacggugagcgggcucuacccgcuggccauccccgugaccaugacccugugguacauguggcaggucaagacccagcgcuccggcgcccucugggacgugcccagccccgccgccacgcagaaggcgacccugaccgagggcguguaccggaucaugcagcgcgggcuguucggcaagacccaggucggggugggcauccacauggaggggguguuccacaccauguggcacgucacgcggggcuccgugaucugccacgagagcggccgccucgagccguccugggccgacgugaagaacgacaugaucagcuacgggggcggguggcggcugggcgacaagugggacaaggaggaggacguccaggugcuggccguggagcccggcaagaaccccaagcacguccagaccaagcccgggcucuucaagacccugaccggcgagaucggggccgugacgcuggacuucaagccgggcaccuccgggagccccaucaucaaccgcaagggcaaggugaucggccucuacgggaacggcgucgugaccaaguccggggacuacgugagcgccaucacccaggcggagcggaucggcgagcccgacuacgaggucgacgaggacaucuuccgcaagaagcgccugacgaucauggaccugcacccgggggccggcaagaccaagcggauccuccccuccaucgugcgcgaggcccugaagcggcgccugcggacccugauccucgcccccacccgcguggucgcggccgagauggaggaggcccugcggggccugcccauccgcuaccagacgccggccgugaagaccgagcacaccgggcgggagaucguggaccucaugugccacgccaccuucacgacccgccugcugagcagcacccggguccccaacuacaaccucaucgugauggacgaggcgcacuucaccgaccccuccagcguggccgcccgcggcuacaucuccacgcgggucgagaugggggaggccgccgcgaucuucaugaccgccacccccccgggcaccacggaccccuucccccagagcaacucccccaucgaggacaucgagcgcgagaucccggagcggagcuggaacaccggguucgacuggaucaccgacuaccagggcaagaccgugugguucguccccuccaucaaggccggcaacgacaucgccaacugccugcgcaagagcgggaagaagguggugcagcugucccggaagacguucgacaccgaguaccccaagaccaagcucaccgacugggacuucgucgugacgaccgacaucagcgagaugggcgccaacuuccgcgcggggcgggugaucgacccccgccgcugccugaagccggucaucaucaccgacggccccgagcgggugauccuggccgggcccauccccgugaccccggccuccgccgcgcagcgccggggccgcaucggccggaaccccgcccaggaggacgaccaguacgucuucagcggggacccccuccgcaacgacgaggaccacgcccacuggacggaggccaagaugcugcuggacaacauccacacccccgagggcaucaucccgacccucuucgggcccgagcgggagaagacccaggccaucgacggcgaguuccgccugcggggcgagcagcgcaagacguucguggagcugaugcggcgcggggaccuccccguguggcuguccuacaaggucgcgagcgccggcaucuccuacaaggaccgggaguggugcuucaccggggagcgcaacaaccagauccuggaggagaacauggagguggagaucuggacccgggagggcgagaagaagaagcuccgccccaaguggcuggacgcccggguguacgccgacccggucgcccugaaggacuucaaggaguucgcgagcgggcgcaaguccaucacccucgacauccugaccgagaucgccagccugcccacguaccucuccagccgggccaagcuggcccuggacaacaucgugaugcuccacaccaccgagcgcggcggcaaggccuaccagcacgcgcugaacgagcugcccgagagccucgagacccugaugcugguggcccuccugggggccaugacggccggcaucuuccuguucuucaugcaggggaagggcauggggaagcucuccaugggccugaucgcgaucgccgucgccagcggccugcucuggguggccgagauccagccgcaguggaucgccgcguccaucauccuggaguucuuccugauggcccuccugauccccgagcccgagaagcagcggaccccccaggacaaccagcugaucuacgugauccucaccauccugaccaucaucgggcuggucgccgccaacgagaugggccucaucgagaagacgaagaccgacuucggguucuaccaggugaagaccgagaccacgauccuggacguggaccugcgcccggccagcgcguggacccucuacgccgucgccaccaccauccugacgcccaugcugcgccacaccaucgagaacaccuccgccaaccucagccuggccgcgaucgccaaccaggccgccgugcugaugggccucgggaagggcuggccccugcaccggauggaccugggcgugccccuccuggccauggggugcuacucccaggucaacccgaccacgcugaccgcgagccucgugaugcugcuggugcacuacgccaucaucggccccgggcuccaggccaaggccacccgcgaggcgcagaagcggaccgccgccggcaucaugaagaaccccacggucgacggcaucaccgugaucgaccuggagcccaucuccuacgacccgaaguucgagaagcagcuggggcaggugaugcuccugguccugugcgccggccagcuccugcugaugcgcaccaccugggccuucugcgaggugcucacgcuggcgaccgggcccauccugacccucugggagggcaaccccgggcgguucuggaacaccacgaucgccgugagcaccgccaacaucuuccgcggcuccuaccuggccggcgccgggcuggcguucagccucaucaagaacacccagaccccccggcgcggcacggggaccaccggcgagacccugggggagaaguggaagcggcagcugaacucccucgaccgcaaggaguucgaggaguacaagcggagcggcauccuggaggucgaccgcaccgaggccaaguccgcccugaaggacggcagcaagaucaaguacgccgugucccgggggacgagcaagauccgcuggaucguggagcggggcauggucaagccgaaggggaaggugguggaccucggcugcgggcgcggcggcugguccuacuacauggccacccugaagaacgucaccgaggugaagggguacaccaagggcgggcccggccacgaggagcccauccccauggcgacguacggguggaaccuggugaagcuccacagcggcgucgacguguucuacaagccgaccgagcagguggacacccugcugugcgacaucggcgagagcuccagcaaccccaccaucgaggaggggcggacgcuccgcguccugaagaugguggagcccuggcuguccagcaagcccgaguucugcaucaaggugcucaacccguacaugcccaccgucaucgaggagcuggagaagcugcagcggaagcacggcgggucccuggugcgcugcccccucagccgcaacuccacccacgagauguacugggucagcggcguguccggcaacaucgugagcuccgucaacaccacgagcaagaugcugcugaaccgguucaccacccgcuaccggaagcccaccuacgagaaggacgccgaccucggggccggcacgcgcuccgugagcaccgagaccgagaagccggacauggccaucaucgggcggcgccugcagcggcugcaggaggagcacaaggagaccuggcacuacgaccaggagaaccccuaccgcacgugggcguaccacggcuccuacgaggcccccagcaccggguccgccagcuccauggugaacggcgucgugaagcuccugaccaagccgugggacgugauccccauggucacccagcuggccaugacggacaccacccccuucggccagcagcggguguucaaggagaagguggacacccgcacgccccagccgaagcccgggacccggaugaucaugaccaccacggccaacuggcucugggcgcugcugggcaagaagaagaacccccgccucugcacccgggaggaguucaucagcaagguccgcagcaacgccgccaucggggccguguuccaggaggagcagggcuggaccuccgccagcgaggcggugaacgacucccgguucugggagcuggucgacaaggagcgcgcccugcaccaggaggggaagugcgagagcugcguguacaacaugaugggcaagcgggagaagaagcucggcgaguucgggcgcgccaagggcucccgggccaucugguacauguggcugggggcccgcuuccuggaguucgaggcgcucggcuuccugaacgaggaccacugguucgggcgggagaacagcugguccggcguggagggcgaggggcugcaccgccucggcuacauccuggaggacaucgacaagaaggacggggaccugaucuacgccgacgacaccgccggcugggacacgcgcaucaccgaggacgaccuccugaacgaggagcugaucaccgagcagauggccccccaccacaagauccucgcgaaggccaucuucaagcugaccuaccagaacaaggucgugaaggugcugcggccgacccccaagggcgccgucauggacaucaucagccgcaaggaccagcggggguccggccagguggggacguacggccucaacaccuucaccaacauggaggugcagcugauccgccagauggaggccgagggggucaucacccgggacgacaugcacaaccccaagggccugaaggagcgcguggagaaguggcucaaggagugcggcguggaccggcugaagcgcauggccaucagcggggacgacugcgucgugaagccccuggacgagcgguucuccacgagccuccuguuccugaacgacaugggcaaggugcgcaaggacaucccgcagugggagcccuccaagggguggaagaacuggcaggagguccccuucugcagccaccacuuccacaagaucuucaugaaggacggccggucccucguggugcccugccgcaaccaggacgagcugaucgggcgggcgcgcaucagccagggcgccggcuggucccugcgggagaccgccugccucgggaaggccuacgcccagauguggagccugauguacuuccaccgccgggaccugcgccucgcgagcauggccaucugcuccgccgucccgaccgagugguuccccaccagccggacgaccugguccauccacgcccaccaccaguggaugaccaccgaggacaugcugaagguguggaaccgcguguggaucgaggacaaccccaacaugacggacaagacccccguccacagcugggaggacaucccguaccugggcaagcgcgaggaccucuggugcgggucccugaucggccugagcucccgggccaccugggcgaagaacauccacaccgccaucacgcaggugcgcaaccucaucgggaaggaggaguacguggacuacaugcccgucaugaagcgguacagcgcccccuucgaguccgagggcgugcuguga

SEQ ID NO: 10424 - RNA, 9867 nt, Artificial Sequence
  derived and/or modified CDS sequence (opt1) from DENV-4__FJ024476__SS-prME
agcaccaucacccugcucugccugauccccaccgugauggccuuccaccuguccacccgggacggcgagccgcucaugaucguggccaagcacgagcgggggcggccccugcuguucaagaccaccgagggcaucaacaagugcacccucaucgccauggaccugggggagaugugcgaggacaccgugaccuacaagugcccccugcucgugaacaccgagcccgaggacaucgacugcuggugcaaccugaccgccaccugggugauguacgggaccugcacccagagcggggagcggcgccgggagaagcgcuccguggcccugaccccgcacagcggcaugggccucgagacccgggccgagaccuggauguccagcgagggggccuggaagcacgcgcagcgcguggaguccuggauccugcggaaccccggcuucgcccugcucgccggguucauggccuacaugaucggccagaccgggauccagcgcacgguguucuucgugcugaugaugcugguggcgcccagcuacggcaugcggugcgugggcguggggaaccgcgacuucguggagggcgucuccgggggcgccuggguggaccucgugcuggagcacggcgggugcgucaccaccauggcccagggcaagcccacccuggacuucgagcucacgaagaccaccgccaaggagguggcccugcugcggaccuacugcaucgaggcgagcaucuccaacaucacgaccgccacccgcugcccgacccagggggagcccuaccucaaggaggagcaggaccagcaguacaucugccggcgcgacguggucgaccggggcugggggaacggcugcggccuguucgggaagggcgggguggugacgugcgccaaguucagcugcuccggcaagaucaccgggaaccugguccagaucgagaaccucgaguacaccgugguggucaccgugcacaacggcgacacgcacgccgucggcaacgacaccagcaaccacggggugaccgccaugaucacgccccggucccccagcguggaggucaagcugccggacuacggcgagcugacgcucgacugcgagccccgguccgggaucgacuucaacgagaugauccugaugaagaugaagaagaagaccuggcuggugcacaagcagugguuccucgaccugccccugcccuggaccgcgggcgccgacaccagcgaggugcacuggaacuacaaggagcgcauggucaccuucaaggugccgcacgccaagcggcaggacgugacgguccucgggucccaggagggcgccaugcacagcgcccuggcgggcgccaccgagguggacagcggggacggcaaccacauguucgccgggcaccugaagugcaaggugcgcauggagaagcuccgcaucaagggcauguccuacaccaugugcagcggcaaguucuccaucgacaaggagauggccgagacccagcacgggacgaccgucgugaaggugaaguacgagggcgccggggcgcccugcaagguccccaucgagauccgggacgugaacaaggagaagguggucggccgcaucaucagcuccacgccccuggccgagaacaccaacagcgugacgaacaucgagcuggagccgcccuucggggacuccuacaucgugaucggcgucggcaacagcgcccucacccugcacugguuccggaagggguccagcaucggcaagauguucgaguccaccuaccgcggggccaagcggauggcgauccugggcgagaccgccugggacuucgggagcgugggcggccucuucacgucccuggggaaggccgugcaccaggucuucggcagcguguacaccaccauguucgggggcguguccuggaugauccgcauccugaucgggcuccugguccuguggaucggcaccaacagccggaacacguccauggccaugaccugcaucgccgugggcgggaucacccuguuccucggcuucaccgugcaggcggacauggggugcgucgugagcugguccggcaaggagcugaagugcgggagcggcaucuucguggucgacaacgugcacacguggaccgagcaguacaaguuccagcccgagagccccgcccgccuggccuccgccauccucaacgcccacaaggacggcgugugcgggauccggagcaccacccgccuggagaacgucauguggaagcagaucacgaacgagcugaacuacgugcucugggagggcgggcacgaccugaccguggucgcgggcgacgugaagggcgugcugaccaaggggaagcgggcccucaccccgcccgucuccgaccugaaguacagcuggaagacguggggcaaggcccgcaucuucacccccgaggcccggaacuccaccuuccugaucgacgggcccgacaccagcgagugcccgaacgagcgccgggccuggaacucccucgagguggaggacuacggcuucgggauguucacgaccaacaucuggaugaaguuccgcgagggcagcuccgaggugugcgaccaccggcugaugagcgcggccaucaaggaccagaaggccguccacgccgacaugggcuacuggaucgaguccagcaagaaccagaccuggcagaucgagcgcgcgucccugaucgaggugaagaccugccucuggcccaagacgcacacccuguggagcaacggggugcuggagucccagaugcucauccccaagagcuacgccggcccguucucccagcacaacuaccggcagggguacgccacccagaccaugggccccuggcaccuggggaagcuggagaucggcuucggcgagugccccgggaccacggucaccauccaggaggacugcgaccaccgcggccccagccuccgcaccaccacggccagcgggaagcuggugacccaguggugcugccgguccugcaccaugccgccccugcgcuuccucggcgaggacgggugcugguacggcauggagauccggccccugagcgagcgcgaggagaacauggugaagucccaggucaccgccggccaggggacgagcgagaccuucuccaugggccugcucugccugacccuguucguggaggagugccuccggcgccgggucacccgcaagcacaugauccuggugguggucaucacgcugugcgcgaucauccucgggggccugaccuggauggaccugcuccgggcccugaucaugcugggcgacaccaugagcgggcgcaucggcgggcagauccaccucgccaucauggccguguucaagaugucccccggcuacgugcugggggucuuccugcggaagcucaccagccgcgagacggcccugauggugaucggcauggcgaugaccaccgugcuguccaucccgcacgaccucauggagcugaucgacggcaucagccuggggcucauccugcugaagaucgucacccaguucgacaacacccaggugggcacccucgcccugucccugaccuucauccggagcaccaugccccucgugauggccuggcgcacgaucauggccguccuguucguggugacccugaucccccucugccggaccuccugccugcagaagcagagccacugggucgagaucaccgcccugauccucggggcgcaggcccugcccguguaccugaugacgcucaugaagggcgccucccgccggagcuggccgcugaacgaggggaucauggccgugggccuggucucccuccugggcagcgcgcugcucaagaacgacgugccccuggccgggcccaugguggccggcgggcugcuccuggccgccuacgucauguccggcagcagcgcggaccugucccucgagaaggccgccaacgugcagugggacgagauggccgacaucaccgggagcucccccaucaucgaggugaagcaggacgaggacggcagcuucuccauccgcgacgucgaggagaccaacaugaucacccugcuggugaagcucgcccugaucacggugagcggccuguacccgcucgcgauccccgucaccaugacccugugguacauguggcaggucaagacccagcgguccggggcccugugggacgugcccagccccgccgccacgcagaaggccgcgcucuccgagggcgucuaccgcaucaugcagcgggggcuguucggcaagacccaggugggggugggcauccacauggagggcgucuuccacaccauguggcacgugacccgcgggagcgugaucugccacgagaccggccgccuggagccguccugggccgacguccggaacgacaugaucagcuacgggggcggcuggcgccucggggacaagugggacaaggaggaggacguccaggugcuggccaucgagcccggcaagaaccccaagcacguccagacgaagcccgggcuguucaagacccucaccggcgagaucggggccgugacccuggacuucaagccgggcacguccggcagccccaucaucaaccggaaggggaaggugaucggccuguacgggaacggcgucgugaccaaguccggggacuacgugagcgccaucacccaggcggagcgcaucggcgagcccgacuacgaggucgacgaggacaucuuccggaagaagcgccucaccaucauggaccugcacccgggcgccgggaagacgaagcggauccugcccuccaucgugcgcgaggcccugaagcggcgccuccggacccugauccuggcccccacccgcguggucgcggccgagauggaggaggcccuccggggccugcccauccgcuaccagaccccggccgucaagagcgagcacacggggcgggagaucguggaccugaugugccacgccaccuucaccacccgccuccuguccagcacgcggguccccaacuacaaccugaucgugauggacgaggcgcacuucaccgaccccagcuccgucgccgcccgcggcuacaucagcacccggguggagaugggggaggccgccgcgaucuucaugaccgccacgcccccgggcgccaccgaccccuucccccaguccaacagccccaucgaggacaucgagcgcgagaucccggagcgcuccuggaacaccggcuucgacuggaucaccgacuaccaggggaagacggugugguucguccccagcaucaaggccggcaacgacaucgccaacugccuccggaaguccgggaagaagguggugcagcugagccgcaagaccuucgacaccgaguaccccaagaccaagcugacggacugggacuucgucgugaccaccgacaucuccgagaugggcgcgaacuuccgggccgggcgcgugaucgacccccggcgcugccucaagccggucauccugaccgacggccccgagcgggugauccuggccggccccauccccgugacgccggccagcgcggcccagcgccgggggcgcaucggccggaaccccgcccaggaggacgaccaguacgucuucuccggggacccccucaagaacgacgaggaccacgcccacuggaccgaggccaagaugcugcuggacaacaucuacacccccgagggcaucaucccgacccucuucggccccgagcgcgagaagacgcaggcgaucgacggggaguuccggcugcgcggcgagcagcggaagaccuucguggagcugaugcgccgcggcgaccuccccguguggcugagcuacaaggucgccuccgccggcaucagcuacaaggaccgcgaguggugcuucaccggggagcggaacaaccagauccuggaggagaacauggagguggagaucuggacccgcgagggcgagaagaagaagcuccggccccgcuggcuggacgcccgcguguacgccgacccgauggcgcugaaggacuucaaggaguucgccuccggccgcaagagcaucacgcucgacauccugaccgagaucgccucccugcccaccuaccucagcucccgcgccaagcuggcccuggacaacaucgucaugcuccacaccaccgagcgcggcgggcgcgcguaccagcacgcccugaacgagcugcccgagagccucgagacgcugaugcugguggcccuccugggggccaugaccgcggggaucuuccuguucuucaugcaggggaagggcaucggcaagcucagcauggggcugaucaccaucgccguggccuccggccugcucugggucgccgagauccagccgcaguggaucgccgcgagcaucauccuggaguucuuccugauggugcuccugauccccgagcccgagaagcagcggacgccccaggacaaccagcugaucuacgugauccucacgauccugaccaucaucgggcugaucgccgccaacgagaugggccucaucgagaagaccaagaccgacuucggguucuaccaggucaagacggagaccaccauccuggacguggaccugcgcccggccuccgccuggacccucuacgcgguggccacgaccauccugacccccaugcugcggcacaccaucgagaacacgagcgccaaccucucccuggccgccaucgcgaaccaggccgccguccugaugggccucggcaagggguggccccugcaccgcauggaccugggcgugccccuccuggccauggggugcuacagccaggugaacccgaccacccugaccgccucccucgucaugcugcuggugcacuacgcgaucaucggccccggccuccaggccaaggccacgcgggaggcccagaagcgcaccgcggccgggaucaugaagaaccccaccguggacggcaucaccgucaucgaccuggagcccaucagcuacgacccgaaguucgagaagcagcugggccaggugaugcuccuggugcugugcgccggccagcuccugcugaugcggacgaccugggccuucugcgagguccucacccuggccaccgggcccauccugacgcucugggagggcaaccccggccgcuucuggaacaccaccaucgcgguguccaccgccaacaucuuccgggggagcuaccuggccggcgccgggcuggccuucucccucaucaagaacgcgcagacgccccgccggggcaccgggaccaccggcgagacgcugggcgagaaguggaagcgccagcugaacagccucgaccggaaggaguucgaggaguacaagcgcuccgggauccuggagguggaccggaccgaggccaagagcgcccugaaggacggcuccaagaucaagcacgccgucagccgcggguccagcaagauccgcuggaucguggagcggggcauggugaagccgaaggggaaggucguggaccucggcugcggccgcgggggcugguccuacuacauggccacccugaagaacgugaccgaggucaagggguacaccaagggcgggcccggccacgaggagcccauccccauggcgacguacggcuggaaccuggugaagcuccacagcgggguggacgucuucuacaagccgaccgagcaggucgacacccugcugugcgacaucggcgagagcuccagcaaccccaccaucgaggaggggcggacgcuccgcgugcugaagauggucgagcccuggcuguccagcaagcccgaguucugcaucaaggugcugaacccguacaugcccaccgucaucgaggagcucgagaagcugcagcggaagcacggcggcaaccuggugcgcugcccccucucccggaacagcacccacgagauguacuggguguccggggccagcggcaacaucgucuccagcgugaacaccacguccaagaugcugcugaaccgcuucaccacccggcaccgcaagcccaccuacgagaaggacguggaccucggggccggcacgcggagcgucuccaccgagaccgagaagccggacaugaccaucaucgggcgccggcugcagcgccugcaggaggagcacaaggagacguggcacuacgaccaggagaaccccuaccggaccugggccuaccacggcagcuacgaggcgcccuccaccggcagcgccuccagcauggugaacgggguggucaagcuccugaccaagccgugggacgugauccccauggugacgcagcuggccaugaccgacaccacccccuucggccagcagcgcgucuucaaggagaagguggacacgcggacgccccagccgaagcccgggacccgcauggugaugaccacgaccgccaacuggcucugggcccugcugggcaagaagaagaacccccggcucugcacccgcgaggaguucaucuccaagguccggagcaacgcggccaucggggccguguuccaggaggagcagggcuggaccagcgccuccgaggccgugaacgacagccgcuucugggagcuggucgacaaggagcgcgcgcugcaccaggagggcaagugcgaguccugcguguacaacaugauggggaagcgggagaagaagcucggcgaguucgggcgcgccaagggcagccgggccaucugguacauguggcugggggcccgcuuccuggaguucgaggcccucggcuuccugaacgaggaccacugguucggccgggagaacuccuggagcgggguggagggcgaggggcugcaccgccucggcuacauccuggaggagaucgacaagaaggacggcgaccugauguacgcggacgacacggccgggugggacacccggaucaccgaggacgaccuccagaacgaggagcugaucaccgagcagauggcgccccaccacaagauccuggccaaggcgaucuucaagcucacguaccagaacaaggucgugaaggugcugcgcccgacgccccggggcgccgucauggacaucaucucccgcaaggaccagcgggggagcggccagguggggaccuacggccugaacaccuucaccaacauggaggugcagcucauccgccagauggaggccgagggcgucaucacgcaggacgacaugcagaaccccaaggggcugcgggagcgcguggagaaguggcugaaggagugcggcguggaccggcucaagcgcauggccaucuccggggacgacugcgucgugaagccccuggacgagcgguucggcaccagccuccuguuccugaacgacauggggaaggugcgcaaggacaucccgcagugggagcccuccaagggcuggaagaacuggcaggagguccccuucugcagccaccacuuccacaagaucuucaugaaggacggccggucccugguggugcccugccgcaaccaggacgagcucaucgggcgcgcccggaucagccagggcgcgggguggucccugcgcgagaccgccugccugggcaaggccuacgcccagauguggagccucauguacuuccaccggcgcgaccugcggcuggccuccauggcgaucugcagcgccgucccgaccgagugguuccccacgagccgcaccaccugguccauccacgcccaccaccaguggaugaccacggaggacaugcucaagguguggaaccggguguggaucgaggacaaccccaacaugaccgacaagacccccguccacagcugggaggacaucccguaccuggggaagcgcgaggaccuguggugcggcucccucaucggccugagcucccgggccaccugggccaagaacauccacacggcgaucacccaggugcgcaaccugaucgggaaggaggaguacguggacuacaugcccgucaugaagcgguacagcgcccccuccgagagcgagggcgugcucuga

SEQ ID NO: 10425 - RNA, 9867 nt, Artificial Sequence
  derived and/or modified CDS sequence (opt1) from DENV-4__GQ868579__SS-prME
agcaccaucacccugcucugccugauccccacgaucauggccuuccaccuguccacccgcgacggcgagccgcucaugaucguggccaagcacgagcgggggcgcccccugcuguucaagaccaccgagggcaucaacaagugcacgcucaucgcgauggaccugggggagaugugcgaggacaccgucaccuacaagugcccccugcucaucaacaccgagcccgaggacaucgacugcuggugcaaccugacgagcaccugggugauguacggcaccugcacccaguccggggagcggcgccgggagaagcgcagcguggcccugacgccgcacuccggcaugggccucgagacccgggccgagaccuggaugagcuccgagggggccuggaagcacgcccagcgcgucgagagcuggauccugcggaaccccggcuucgcgcugcucgccggguucauggccuacaugaucggccagaccgggauccagcgcacgguguucuucauccugaugaugcugguggcccccuccuacggcaugcggugcgucggcguggggaaccgcgacuucguggagggcgucagcgggggcgcguggguggaccucgugcuggagcacggcgggugcgucaccaccauggcccagggcaagcccacccuggacuucgagcucacgaagaccaccgccaaggagguggcccugcugcggaccuacugcaucgaggcccucaucuccaacaucacgaccgcgacccgcugcccgacccagggggagcccuaccugaaggaggagcaggaccagcaguacaucugccggcgcgacguggucgaccggggcugggggaacggcugcggccuguucgggaagggcgggguggugacgugcgccaaguucagcugcuccggcaagaucaccgggaaccucguccagaucgagaaccuggaguacaccgugguggucaccgugcacaacggcgacacgcacgccgugggcaacgacaccagcaaccacggggucaccgccaccaucacgccccgcucccccagcguggaggucaagcugccggacuacggcgagcucacccuggacugcgagccccgguccgggaucgacuucaacgagaugauccugaugaagaugaagaagaagaccuggcucgugcacaagcagugguuccuggaccugccccuccccuggaccgccggcgcggacaccagcgaggugcacuggaacuacaaggagcgcauggucacguucaaggugccgcacgccaagcggcaggacgugaccguccuggggucccaggagggcgccaugcacagcgcccuggccggcgcgaccgagguggacagcggggacggcaaccacauguucgccgggcaccucaagugcaaggugcgcauggagaagcugcgcaucaagggcauguccuacaccaugugcagcggcaaguucuccaucgacaaggagauggccgagacgcagcacgggaccaccgucgugaaggugaaguacgagggcgccggggcccccugcaagguccccaucgagauccgggacgugaacaaggagaagguggucggccgcgugaucagcuccaccccccuggcggagaacacgaacagcgugaccaacaucgagcucgagccgcccuucggggacuccuacaucgucaucggcgugggcaacagcgcccugacccugcacugguuccggaagggguccagcaucggcaagauguucgaguccaccuaccgcggggccaagcggauggccauccucggcgagacggcgugggacuucgggagcgugggcggccuguucaccucccuggggaaggccguccaccagguguucggcagcguguacaccaccauguucgggggcgucuccuggaugauccgcauccucaucggguuccuggugcuguggaucggcacgaacagccggaacaccuccauggccaugaccugcaucgccgugggcgggaucacccuguuccucggcuucacgguccgcgccgacauggggugcguggugagcugguccggccgggagcugaagugcgggagcggcaucuucgucguggacaacgugcacaccuggaccgagcaguacaaguuccagcccgagagccccgcgcgccuggccuccgccauccucaacgcccacaaggacggcgucugcgggauccggagcaccacgcgccuggagaacgugauguggaagcagaucaccaacgagcugaacuacgugcucugggagggcgggcacgaccugaccgucguggccggcgacgugaagggcguccugaccaaggggaagcgggcgcucacgccgcccguguccgaccugaaguacagcuggaagaccuggggcaaggccaagaucuucacccccgaggcccgcaacuccaccuuccugaucgacgggcccgacacgagcgagugcccgaacgagcggcgcgccuggaacucccucgagguggaggacuacggcuucgggauguucaccaccaacaucuggaugaaguuccgggagggcagcuccgaggucugcgaccaccgccugaugagcgccgcgaucaaggaccagaaggccgugcacgccgacaugggcuacuggaucgaguccagcaagaaccagaccuggcagaucgagcgggccucccugaucgaggugaagacgugccucuggcccaagacccacacccuguggagcaacgggguccuggagucccagaugcucauccccaagagcuacgcgggcccguucucccagcacaacuaccgccagggguacgccacccagaccgugggccccuggcaccuggggaagcuggagaucgacuucggcgagugccccggcacgaccgugaccauccaggaggacugcgaccaccgcgggcccagccuccggaccacgaccgccagcggcaagcuggucacccaguggugcugccgcuccugcaccaugccgccccugcgguuccucggggaggacggcugcugguacgggauggagauccgcccccugagcgagaaggaggagaacauggugaagucccaggugacggccggccagagcaccuccgagaccuucagcaugggccugcucugccugacccuguucgucgaggagugccuccggcgccgggugacgcgcaagcacaugauccuggccgucgugaucacccugugcgcgaucauccucgggggccugaccuggauggaccugcuccgggcccugaucaugcugggggacaccauguccggccgcaucggcgggcagacgcaccucgccaucauggccguguucaagaugagccccggcuacguccuggggguguuccugcggaagcucaccucccgcgagaccgcccugauggugaucggcauggcgaugaccacgacccugagcaucccgcacgaccucauggagcugaucgacgggaucucccugggccucauccugcugaagaucgucacccaguucgacaacacccaggugggcacgcucgcccugagccugaccuucauccgguccaccaugagccucgugauggccuggcgcaccaucauggccguccuguucguggugacgcugaucccccucugccggaccuccugccugcagaagcagagccacugggucgagaucaccgcccugauccucggggcgcaggcccugcccguguaccugaugacccucaugaagggcgccucccgccggagcuggccccugaacgaggggaucauggccgugggccuggucucccuccuggggagcgcgcugcucaagaacgacgugccgcuggccggccccaugguggccggcgggcugcuccuggccgccuacgucaugagcggcuccagcgcggaccugucccucgagaaggccgccaacgugcagugggacgagauggccgacaucacggggagcucccccaucaucgaggugaagcaggacgaggacggcagcuucuccauccgcgacgucgaggagaccaacaugaucacccugcuggugaagcucgcccugaucaccgugagcgggcuguacccccucgcgaucccggucacgaugacccugugguacauguggcaggugaagacccagcgguccggcgcccugugggacgugcccagccccgccgccacccagaaggccgcgcucuccgagggcgucuaccgcaucaugcagcgggggcuguucggcaagacccaggugggggugggcauccacauggagggggucuuccacacgauguggcacgugacccgcggcagcgugaucugccacgagaccggccgccuggagcccuccugggccgacguccggaacgacaugaucagcuacgggggcggguggcgccucggcgacaagugggaccgggaggaggacgugcaggugcuggccaucgagccgggcaagaaccccaagcacguccagaccaagcccgggcuguucaagacgcucaccggcgagaucggggccgugacccuggacuucaagcccggcaccuccgggagcccgaucaucaacaagaagggcaaggugaucggccuguacgggaacggcgucgugacgaaguccggggacuacgugagcgccaucacccaggcggagcgcaucggcgagcccgacuacgaggucgacgaggacaucuuccggaagaagcgccucaccaucauggaccugcaccccggggccggcaagaccaagcggauccugccguccaucgugcgcgaggcccugaagcggcgccuccggacgcugauccuggcccccacccgcguggucgcggccgagauggaggaggcccuccggggccugcccauccgcuaccagacccccgccgugaagagcgagcacaccgggcgggagaucguggaccugaugugccacgccacguucaccacccgccuccugagcuccacccgggucccgaacuacaaccugaucgugauggacgaggcgcacuucacggaccccagcuccguggccgcccgcggcuacaucagcacccgggucgagaugggggaggccgccgcgaucuucaugaccgccaccccccccggcgccacggacccguucccccaguccaacagccccaucgaggacaucgagcgcgagauccccgagcgcuccuggaacaccggguucgacuggaucaccgacuaccagggcaagaccgugugguucgucccgagcaucaaggccggcaacgacaucgccaacugccuccggaaguccgggaagaaggugauccagcugagccgcaagacguucgacaccgaguaccccaagaccaagcugaccgacugggacuucguggucacgaccgacaucuccgagaugggcgcgaacuuccgggccgggcgcgugaucgacccccggcgcugccucaagcccgugauccugaccgacggcccggagcgggucauccuggccgggcccauccccgugacccccgccagcgcggcccagcgccggggccgcaucggccggaacccggcccaggaggacgaccaguacguguucuccggggacccccucaagaacgacgaggaccacgcccacuggacggaggccaagaugcugcuggacaacaucuacacccccgagggcaucauccccacccucuucgggccggagcgcgagaagacccaggcgaucgacggcgaguuccggcugcgcggcgagcagcggaagacguucgucgagcugaugcgccggggggaccuccccguguggcugagcuacaagguggccuccgccggcaucagcuacaaggaccgcgaguggugcuucaccggggagcggaacaaccagauccuggaggagaacauggaggucgagaucuggacccgcgagggcgagaagaagaagcuccggccccgcuggcuggacgcccgcguguacgccgaccccauggcgcugaaggacuucaaggaguucgccuccgggcggaagagcaucacccucgacauccugaccgagaucgccucccugccgacguaccucagcagccgcgccaagcuggcccuggacaacaucgugaugcuccacaccaccgagcggggcggccgcgcguaccagcacgcccugaacgagcugcccgagucccucgagacccugaugcuggucgcccuccugggggccaugacggcgggcaccuuccuguucuucaugcaggggaagggcaucgggaagcucagcaugggccugaucaccaucgccauggccuccggccugcucuggaucgccgagauccagccccaguggaucgccgcgagcaucauccuggaguucuuccugauggugcuccugaucccggagcccgagaagcagcggaccccccaggacaaccagcugaucuacgugauccucacgauccuggccaucaucgggcugaucgccgccaacgagaugggccucaucgagaagaccaagaccgacuucggguucuaccaggucaagaccgagacgaccauccuggacguggaccugcgccccgccuccgcguggacccucuacgccguggccaccacgauccugaccccgaugcugcggcacaccaucgagaacaccagcgccaaccucucccuggccgcgaucgccaaccaggccgccguccugaugggccucgggaagggcuggccccugcaccgcauggaccugggcgugccccuccuggccauggggugcuacagccaggugaaccccacgacccugaccgcgucccucgucaugcugcuggugcacuacgccaucaucggcccggggcuccaggccaaggccacccgggaggcgcagaagcgcacggccgccggcaucaugaagaaccccaccguggacggcaucaccgucaucgaccuggagcccaucagcuacgaccccaaguucgagaagcagcuggggcaggugaugcuccuggugcugugcgccggccagcuccugcugaugcggaccacgugggccuucugcgagguccucacccuggcgaccgggccgauccugacccucugggagggcaaccccgggcgcuucuggaacacgaccaucgccguguccaccgccaacaucuuccggggcagcuaccuggccggcgccgggcuggcguucucccucaucaagaacgcccaggccccccgccggggcaccgggacgaccggcgagacccugggggagaaguggaagcgccagcugaacagccucgaccggaaggaguucgaggaguacaagcgcuccggcauccuggagguggaccggaccgaggccaagagcgcccugaaggacggcuccaagaucaagcacgcggucagccgcggguccagcaagauccgcuggaucguggagcggggcauggugaagcccaaggggaaggucguggaccucggcugcgggcgcggcggcuggagcuacuacauggccacccugaagaacgugacggaggucaagggguacaccaagggcgggccgggccacgaggagcccauccccauggccaccuacggguggaaccuggugaagcuccacuccggcguggacgucuucuacaagcccaccgagcagguggacacgcugcugugcgacaucggcgagagcuccagcaacccgaccaucgaggaggggcggacccuccgcgugcugaagauggucgagcccuggcuguccagcaagcccgaguucugcaucaaggugcugaaccccuacaugccgaccgugaucgaggagcucgagaagcugcagcggaagcacggcgggaaccugguccgcugcccccucucccggaacagcacgcacgagauguacuggguguccggcgccagcggcaacaucguguccagcgucaacaccaccuccaagaugcugcugaaccgcuucaccacgcggcaccgcaagcccaccuacgagaaggacguggaccucggggcgggcacccggagcgucuccaccgagacggagaagcccgacaugaccaucaucgggcgccggcugcagcgccugcaggaggagcacaaggagaccuggcacuacgaccaggagaacccguaccggaccugggccuaccacggcagcuacgaggcccccuccacggggagcgccuccagcauggugaacggcguggucaagcuccugaccaagcccugggacgugaucccgauggugacccagcuggccaugaccgacacgacccccuucggccagcagcgcgucuucaaggagaagguggacacccggaccccccagcccaagccggggacgcgcauggugaugaccaccaccgcgaacuggcucugggcccugcugggcaagaagaagagcccccggcucugcacgcgcgaggaguucaucuccaagguccggagcaacgccgccaucggggccguguuccaggaggagcagggcuggaccuccgcgagcgaggccgugaacgacucccgcuucugggagcuggucgacaaggagcgcgcccugcaccaggaggggaagugcgagagcugcguguacaacaugaugggcaagcgggagaagaagcucggcgaguucgggcgcgccaagggcucccgggccaucugguacauguggcugggggcgcgcuuccuggaguucgaggcccucggcuuccugaacgaggaccacugguucgggcgggagaacagcugguccggcguggagggcgaggggcugcaccgccucggcuacauccuggaggagaucgacaagaaggacggggaccugauguacgccgacgacaccgccggcugggacacccggaucacggaggacgaccuccagaacgaggagcugaucaccgagcagauggcgccccaccacaagauccuggccaaggccaucuucaagcucaccuaccagaacaaggucgugaaggugcugcgccccaccccgcggggcgccgucauggacaucaucagccgcaaggaccagcggggguccggccagguggggaccuacggccugaacacguucaccaacauggaggugcagcucauccgccagauggaggccgagggggucaucacccaggacgacaugcagaaccccaagggccugaaggagcggguggagaacuggcugcgcgagugcggcguggaccggcucaagcgcauggcgaucagcggggacgacugcgucgugaagccccuggacgagcgguucggcaccucccugcucuuccugaacgacauggggaaggugcgcaaggacaucccccagugggagccgagcaagggcuggaagaacuggcaggagguccccuucugcucccaccacuuccacaagaucuucaugaaggacgggcggagccugguggugcccugccgcaaccaggacgagcucaucggccgcgcccggaucucccagggcgccggguggagccugcgcgagacggccugccugggcaaggccuacgcgcagauguggagccucauguacuuccaccggcgcgaccugcggcuggccuccauggccaucugcagcgccguccccaccgagugguucccgaccucccgcaccacguggagcauccacgcccaccaccaguggaugaccaccgaggacaugcucaagguguggaaccggguguggaucgaggacaaccccaacaugaucgacaagacccccguccacuccugggaggacauccccuaccuggggaagcgcgaggaccuguggugcggcagccucaucgggcuguccagccgggcgacgugggccaagaacauccacaccgccaucacccaggugcgcaaccugaucggcaaggaggaguacguggacuacaugccggucaugaagcgguacuccgcccccagcgaguccgagggcgugcucuga

SEQ ID NO: 10426 - RNA, 9867 nt, Artificial Sequence
  derived and/or modified CDS sequence (opt1) from DENV-4__GQ868580__SS-prME
agcaccaucacccugcucugccugauccccacgaucauggccuuccaccuguccacccgcgacggcgagccgcucaugaucguggccaagcacgagcgggggcgcccccugcuguucaagaccaccgagggcaucaacaagugcacgcucaucgcgauggaccugggggagaugugcgaggacaccgucaccuacaagugcccccugcucaucaacaccgagcccgaggacaucgacugcuggugcaaccugacgagcaccugggugauguacggcaccugcacccaguccggggagcggcgccgggagaagcgcagcguggcccugacgccgcacuccggcaugggccucgagacccgggccgagaccuggaugagcuccgagggggccuggaagcacgcccagcgcgucgagagcuggauccugcggaaccccggcuucgcgcugcucgccggguucauggccuacaugaucggccagaccgggauccagcgcacgguguucuucgugcugaugaugcuggucgcccccuccuacggcaugcggugcgugggcguggggaaccgcgacuucgucgagggcgugagcgggggcgcguggguggaccucguccuggagcacggcgggugcgugaccaccauggcccagggcaagcccacccuggacuucgagcucacgaagaccaccgccaaggagguggcccugcugcggaccuacugcaucgaggcccucaucuccaacaucacgaccgcgacccgcugcccgacccagggggagcccuaccugaaggaggagcaggaccagcaguacaucugccggcgcgacgucguggaccggggcugggggaacggcugcggccuguucgggaagggcgggguggucacgugcgccaaguucagcugcuccggcaagaucaccgggaaccucgugcagaucgagaaccuggaguacaccguggucgugaccgugcacaacggcgacacgcacgccgucggcaacgacaccagcaaccacggggugaccgccaccaucacgccccgcucccccagcgucgaggugaagcugccggacuacggcgagcucacccuggacugcgagccccgguccgggaucgacuucaacgagaugauccugaugaagaugaagaagaagaccuggcucgugcacaagcagugguuccuggaccugccccuccccuggaccgccggcgcggacaccagcgagguccacuggaacuacaaggagcgcauggugacguucaaggugccgcacgccaagcggcaggacgucaccgugcuggggucccaggagggcgccaugcacagcgcccuggccggcgcgaccgagguggacagcggggacggcaaccacauguucgccgggcaccucaagugcaagguccgcauggagaagcugcgcaucaagggcauguccuacaccaugugcagcggcaaguucuccaucgacaaggagauggccgagacgcagcacgggaccaccguggugaaggucaaguacgagggcgccggggcccccugcaaggugcccaucgagauccgggacgugaacaaggagaaggucgugggccgcaucaucagcuccaccccccuggcggagaacacgaacagcgugaccaacaucgagcucgagccgcccuucggggacuccuacaucgucaucggcgugggcaacagcgcccugacccugcacugguuccggaagggguccagcaucggcaagauguucgaguccaccuaccgcggggccaagcggauggccauccucggcgagacggcgugggacuucgggagcgugggcggccuguucaccucccuggggaaggccguccaccagguguucggcagcguguacaccaccauguucgggggcgucuccuggaugauccgcauccucaucggguuccuggugcuguggaucggcacgaacagccggaacaccuccauggccaugaccugcaucgccgugggcgggaucacccuguuccucggcuucacgguccaggccgacauggggugcguggugagcugguccggccgcgagcugaagugcgggagcggcaucuucgucguggacaacgugcacaccuggaccgagcaguacaaguuccagcccgagagccccgcgcggcuggccuccgccauccucaacgcccacaaggacggcgucugcgggauccgcagcaccacgcggcuggagaacgugauguggaagcagaucaccaacgagcugaacuacgugcucugggagggcgggcacgaccugaccgucguggccggcgacgugaagggcguccugaccaaggggaagcgcgcgcucacgccgcccguguccgaccugaaguacagcuggaagaccuggggcaaggccaagaucuucacccccgaggcccggaacuccaccuuccugaucgacgggcccgacacgagcgagugcccgaacgagcgccgggccuggaacucccucgagguggaggacuacggcuucgggauguucaccaccaacaucuggaugaaguuccgcgagggcagcuccgaggucugcgaccaccggcugaugagcgccgcgaucaaggaccagaaggccgugcacgccgacaugggcuacuggaucgaguccagcaagaaccagaccuggcagaucgagcgcgccucccugaucgaggugaagacgugccucuggcccaagacccacacccuguggagcaacgggguccuggagucccagaugcucauccccaagagcuacgcgggcccguucucccagcacaacuaccggcagggguacgccacccagaccgugggccccuggcaccuggggaagcuggagaucgacuucggcgagugccccggcacgaccgugaccauccaggaggacugcgaccaccgcgggcccagccuccgcaccacgaccgccagcggcaagcuggucacccaguggugcugccgguccugcaccaugccgccccugcgcuuccucggggaggacggcugcugguacgggauggagauccggccccugaacgagaaggaggagaacauggugaagagccaggugacggccggccaguccaccagcgagaccuucuccaugggccugcucugccugacccuguucgucgaggagugccuccgccggcgcgugacgcggaagcacaugauccuggccgucgugaucacccugugcgcgaucauccucgggggccugaccuggauggaccugcuccgcgcccugaucaugcugggggacaccaugagcggccggaucggcgggcagacgcaccucgccaucauggccguguucaagaugucccccggcuacguccuggggguguuccugcgcaagcucaccagccgggagaccgcccugauggugaucggcauggcgaugaccacgaccuucuccaucccgcacgaccugauggagcucaucgacgggaucagccugggccugauccuccugaagaucgucacccaguucgacaacacccaggugggcacgcuggcccucucccugaccuucauccgcagcaccaugucccuggugauggccuggcggaccaucauggccguccucuucguggugacgcugaucccccugugccgcaccagcugccuccagaagcagucccacugggucgagaucaccgcccugauccugggggcgcaggcccuccccguguaccugaugacccugaugaagggcgccagccggcgcuccuggccccucaacgaggggaucauggccgugggccuggucagccugcucggguccgcgcugcugaagaacgacgugccgcucgccggccccaugguggccggcgggcugcugcucgccgccuacgucaugagcggcagcuccgcggaccugagccuggagaaggccgccaacgugcagugggacgagauggccgacaucacgggguccagccccaucaucgaggugaagcaggacgaggacggcuccuucagcauccgggacgucgaggagaccaacaugaucacccuccuggugaagcuggcccucaucaccguguccgggcuguacccccuggcgaucccggucacgaugacccucugguacauguggcaggugaagacccagcgcagcggcgcccugugggacgugcccucccccgccgccacccagaaggccgcgcugagcgagggcgucuaccggaucaugcagcgcgggcuccugggcaagacccaggugggggugggcauccacauggagggggucuuccacacgauguggcacgugacccggggcuccgugaucugccacgagaccggccgccuggagcccagcugggccgacguccgcaacgacaugaucuccuacgggggcggguggcggcucggcgacaagugggaccgcgaggaggacgugcaggugcuggccaucgagccgggcaagaaccccaagcacguccagaccaagcccgggcuguucaagacgcucaccggcgagaucggggccgugacccuggacuucaagcccggcaccagcggguccccgaucaucaaccggaagggcaaggugaucggccuguacgggaacggcgucgugacgaagagcggggacuacguguccgccaucacccaggcggagcgcaucggcgagcccgacuacgaggucgacgaggacaucuuccggaagaagcgccucaccaucauggaccugcaccccggggccggcaagaccaagcggauccugccgagcaucgugcgcgaggcccugaagcggcgccuccggacgcugauccuggcccccacccgcguggucgcggccgagauggaggaggcccuccggggccugcccauccgcuaccagacccccgccgugaaguccgagcacaccgggcgggagaucguggaccugaugugccacgccacguucaccacccgccuccugagcagcacccgggucccgaacuacaaccugaucgugauggacgaggcgcacuucacggaccccuccagcguggccgcccgcggcuacaucuccacccgggucgagaugggggaggccgccgcgaucuucaugaccgccaccccccccggcgccacggacccguucccccagagcaacucccccaucgaggacaucgagcgcgagauccccgagcgcagcuggaacaccggguucgacuggaucaccgacuaccagggcaagaccgugugguucgucccguccaucaaggccggcaacgacaucgccaacugccuccggaagagcgggaagaaggugauccagcugucccgcaagacguucgacaccgaguaccccaagaccaagcugaccgacugggacuucguggucacgaccgacaucagcgagaugggcgcgaacuuccgggccgggcgcgugaucgacccccggcgcugccucaagcccgugauccugaccgacggcccggagcgggucauccuggccgggcccauccccgugacccccgccuccgcggcccagcgccggggccgcaucggccggaacccggcccaggaggacgaccaguacguguucagcggggacccccucaagaacgacgaggaccacgcccacuggacggaggccaagaugcugcuggacaacaucuacacccccgagggcaucauccccacccucuucgggccggagcgcgagaagacccaggcgaucgacggcgaguuccggcugcgcggcgagcagcggaagacguucgucgagcugaugcgccggggggaccuccccguguggcuguccuacaagguggccagcgccggcaucuccuacaaggaccgcgaguggugcuucaccggggagcggaacaaccagauccuggaggagaacauggaggucgagaucuggacccgcgagggcgagaagaagaagcuccggccccgcuggcuggacgcccgcguguacgccgaccccauggcgcugaaggacuucaaggaguucgccagcgggcggaaguccaucacccucgacauccugaccgagaucgccagccugccgacguaccucuccagccgcgccaagcuggcccuggacaacaucgugaugcuccacaccaccgagcggggcggccgcgcguaccagcacgcccugaacgagcugcccgagagccucgagacccugaugcuggucgcccuccugggggccaugacggcgggcaucuuccuguucuucaugcaggggaagggcaucgggaagcucuccaugggccugaucaccaucgccauggccagcggccugcucuggaucgccgagauccagccccaguggaucgccgcguccaucauccuggaguucuuccugauggugcuccugaucccggagcccgagaagcagcggaccccccaggacaaccagcugaucuacgugauccucaccauccugacgaucaucgggcugaucgccgccaacgagaugggccucaucgagaagaccaagaccgacuucggguucuaccaggucaagaccgagacgaccauccuggacguggaccugcgccccgccagcgccuggacccucuacgcgguggccaccacgauccugaccccgaugcugcggcacaccaucgagaacaccuccgccaaccucagccuggccgccaucgcgaaccaggccgccguccugaugggccucgggaagggcuggccccugcaccgcauggaccugggcgugccccuccuggccauggggugcuacucccaggugaaccccacgacccugaccgccagccucgucaugcugcuggugcacuacgcgaucaucggcccggggcuccaggccaaggccacccgggaggcccagaagcgcacggcggccggcaucaugaagaaccccaccguggacggcaucaccgucaucgaccuggagcccaucuccuacgaccccaaguucgagaagcagcuggggcaggugaugcuccuggugcugugcgccggccagcuccugcugaugcggaccacgugggccuucugcgagguccucacccuggccaccgggccgauccugacccucugggagggcaaccccgggcgcuucuggaacacgaccaucgcggugagcaccgccaacaucuuccggggcuccuaccuggccggcgccgggcuggccuucagccucaucaagaacgcgcagaccccccgccggggcacggggaccaccggcgagacccugggggagaaguggaagcgccagcugaacucccucgaccggaaggaguucgaggaguacaagcgcagcggcauccuggagguggaccggaccgaggccaaguccgcccugaaggacggcagcaagaucaagcacgccgucucccgcgggagcuccaagauccgcuggaucguggagcggggcauggugaagcccaaggggaaggucguggaccucggcugcgggcgcggcggcuggagcuacuacauggccacgcugaagaacgugaccgaggucaagggguacaccaagggcgggccgggccacgaggagcccauccccauggcgaccuacggguggaaccuggugaagcuccacagcggcguggacgucuucuacaagcccacggagcagguggacacccugcugugcgacaucggcgaguccagcuccaacccgaccaucgaggaggggcggacccuccgcgugcugaagauggucgagcccuggcugagcuccaagcccgaguucugcaucaaggugcugaaccccuacaugccgacggugaucgaggagcucgagaagcugcagcggaagcacggcgggaaccugguccgcugcccccucagccggaacuccacccacgagauguacugggugagcggcgccuccggcaacaucgugagcuccgucaacaccaccagcaagaugcugcugaaccgcuucacgacccggcaccgcaagcccaccuacgagaaggacguggaccucggggccggcacccgguccgucagcacggagaccgagaagcccgacaugaccaucaucgggcgccggcugcagcgccugcaggaggagcacaaggagaccuggcacuacgaccaggagaacccguaccggacgugggccuaccacggcuccuacgaggcgcccagcaccggguccgccagcuccauggugaacggcguggucaagcuccugaccaagcccugggacgugaucccgauggugacccagcuggccaugacggacaccacccccuucggccagcagcgcgucuucaaggagaagguggacacccggacgccccagcccaagccggggacccgcauggugaugaccaccacggccaacuggcucugggcccugcugggcaagaagaagagcccccggcucugcacccgcgaggaguucaucagcaagguccgguccaacgcggccaucggggccguguuccaggaggagcagggcuggaccagcgccuccgaggccgugagcgacucccgcuucugggagcuggucgacaaggagcgcgcgcugcaccaggaggggaagugcgagagcugcguguacaacaugaugggcaagcgggagaagaagcucggcgaguucgggcgcgccaagggcucccgggccaucugguacauguggcugggggcccgcuuccuggaguucgaggcccucggcuuccugaacgaggaccacugguucgggcgggagaacagcugguccggcguggagggcgaggggcugcaccgccucggcuacauccuggaggagaucgacaagaaggacggggaccugauguacgcggacgacaccgccggcugggacacgcggaucaccgaggacgaccuccagaacgaggagcugaucaccgagcagauggccccccaccacaagauccuggccaaggcgaucuucaagcucaccuaccagaacaaggucgugaaggugcugcgccccaccccgcggggcgccgucauggacaucaucagccgcaaggaccagcggggguccggccagguggggacguacagccugaacaccuucaccaacauggaggugcagcucauccgccagauggaggccgagggcgucaucacccaggacgacaugcagaaccccaaggggcugaaggagcggguggagaacuggcugcgcgagugcggcguggaccggcucaagcgcauggccaucuccggcgacgacugcgucgugaagccccuggacgagcgguucgggacgagccugcucuuccugaacgacaugggcaaggugcgcaaggacaucccccagugggagccguccaagggguggaagaacuggcaggagguccccuucugcagccaccacuuccacaagaucuucaugaaggacggccggucccugguggugcccugccgcaaccaggacgagcucaucgggcgcgcccggaucagccagggcgcgggcuggagccugcgcgagaccgccugccuggggaaggccuacgcccagauguggucccucauguacuuccaccggcgcgaccugcggcuggccagcauggcgaucugcuccgccguccccaccgagugguucccgaccagccgcacgaccugguccauccacgcccaccaccaguggaugaccaccgaggacaugcucaagguguggaaccggguguggaucgaggacaaccccaacaugaucgacaagacgcccguccacagcugggaggacauccccuaccugggcaagcgcgaggaccuguggugcgggucccucaucggccugagcucccgggccaccugggccaagaacauccacaccgcgaucacccaggugcgcaaccugaucgggaaggaggaguacguggacuacaugccggucaugaagcgguacagcgcccccuccgagagcgagggcgugcucuga

SEQ ID NO: 10427 - RNA, 9867 nt, Artificial Sequence
  derived and/or modified CDS sequence (opt1) from DENV-4__GQ868583__SS-prME
agcaccaucacccugcucugccugauccccacggugauggccuuccaccuguccacccgcgacggcgagccgcucaugaucgucgccaagcacgagcgggggcgcccccugcuguucaagaccaccgagggcaucaacaagugcacgcucaucgcgauggaccugggggagaugugcgaggacaccgugaccuacaagugcccccugcucgugaacaccgagcccgaggacaucgacugcuggugcaaccugacgagcaccugggucauguacggcaccugcacccaguccggggagcggcgccgggagaagcgcagcguggcccugacgccgcacuccggcaugggccucgagacccgggccgagaccuggaugagcuccgagggggccuggaagcacgcccagcgcguggagagcuggauccugcggaaccccggcuucgcgcugcucgccggguucauggccuacaugaucggccagaccgggauccagcgcacggucuucuucgugcugaugaugcugguggcccccuccuacggcaugcggugcgucggcguggggaaccgcgacuucguggagggcgucagcgggggcgcguggguggaccucgugcuggagcacggcgggugcgucaccaccauggcccagggcaagcccacccuggacuucgagcucacgaagaccaccgccaaggagguggcccugcugcggaccuacugcaucgaggcccucaucuccaacaucacgaccgcgacccgcugcccgacccagggggagcccuaccugaaggaggagcaggaccagcaguacaucugccggcgcgacguggucgaccggggcugggggaacggcugcggccuguucgggaagggcgggguggugacgugcgccaaguucagcugcuccggcaagaucaccgggaaccucguccagaucgagaaccuggaguacaccgugguggucaccgugcacaacggcgacacgcacgccgucggcaacgacaccagcaaccacggggugaccgccaccaucacgccccgcucccccagcguggaggucaagcugccggacuacggcgagcucacccuggacugcgagccccgguccgggaucgacuucaacgagaugauccugaugaagaugaagaagaagaccuggcucgugcacaagcagugguuccuggaccugccccuccccuggaccaccggcgccgacacgagcgaggugcacuggaacuacaaggagcgcauggucaccuucaaggugccgcacgcgaagcggcaggacgugaccguccuggggucccaggagggcgccaugcacagcgcccuggccggcgccaccgagguggacagcggggacggcaaccacauguucgcggggcaccucaagugcaaggugcgcauggagaagcugcgcaucaagggcauguccuacacgaugugcagcggcaaguucuccaucgacaaggagauggccgagacccagcacgggaccaccgucgugaaggugaaguacgagggcgccggggcccccugcaagguccccaucgagauccgggacgugaacaaggagaagguggucggccgcgugaucagcgccacgccccuggcggagaacaccaacuccgugaccaacaucgagcucgagccgcccuucggggacagcuacaucaugaucggcgucggcaacuccgcccugacccugcacugguuccggaaggggagcuccaucggcaagauguucgagagcacguaccgcggggccaagcggauggccauccucggcgagaccgcgugggacuucggguccgugggcggccuguucaccagccuggggaaggccgugcaccaggucuucggcuccguguacaccacgauguucgggggcgugagcuggaugauccgcauccucaucggguuccugguccuguggaucggcaccaacucccggaacaccagcauggccaugaccugcaucgccgugggcgggaucacgcuguuccucggcuucaccgugcaggccgacauggggugcgucguguccuggagcggccgcgagcugaagugcggguccggcaucuucguggucgacaacgugcacaccuggaccgagcaguacaaguuccagcccgagagccccgcgcggcuggccagcgccauccucaacgcccacaaggacggcgugugcgggauccgcuccacgacccggcuggagaacgucauguggaagcagaucaccaacgagcugaacuacgugcucugggagggcgggcacgaccugaccguggucgccggcgacgugaagggcgugcugacgaaggggaagcgcgcgcucgccccgcccgccagcgaccugaaguacuccuggaagaccuggggcaaggccaagaucuucacccccgaggcccggaacagcaccuuccugaucgacgggcccgacacguccgagugcccgaacgagcgccgggcguggaacagcuucgaggucgaggacuacggcuucgggauguucaccaccaacaucuggaugaaguuccgcgagggcuccagcgaggugugcgaccaccggcucauguccgccgccaucaaggaccagaaggccgugcacgcggacaugggcuacuggaucgagagcuccaagaaccagaccuggcagaucgagcgcgccagccugaucgaggucaagacgugccuguggcccaagacccacacccucugguccaacggggugcuggagagccagaugcugauccccaaguccuacgccggcccguucagccagcacaacuaccggcagggguacgccacccagaccgugggccccuggcaccucgggaagcuggagaucgacuucggcgagugccccggcacgaccgucaccauccaggaggacugcgaccaccgcgggcccucccugcgcaccacgaccgccagcggcaagcucgugacccaguggugcugccggagcugcaccaugccgccccugcgcuuccugggggaggacggcugcugguacgggauggagauccggccccucuccgagaaggaggagaacauggugaagagccaggucacggcgggccagggcaccuccgagaccuucagcauggggcugcugugccucacccuguucguggaggagugccugcgccggcgcgucacgcggaagcacaugauccucgccguggugaucacccugugcgccaucauccugggcgggcucaccuggauggaccugcugcgcgcccucaucaugcugggcgacaccauguccggccggaucgggggccagacgcaccuggccaucauggcggucuucaagaugagccccggguacgugcucggcguguuccugcgcaagcugaccucccgggagaccgcccucauggucaucgggauggccaugaccacgacccugagcaucccgcacgaccugauggagcucaucgacggcaucucccugggccugauccuccugaagaucgugacccaguucgacaacacccagguggggacgcuggcccucagccugaccuucauccgcuccaccaugagccuggucauggccuggcggaccaucauggcggugcucuucguggucacgcugaucccccugugccgcaccuccugccuccagaagcagagccacuggguggagaucaccgcccugauccugggcgcccaggcccuccccguguaccugaugacccugaugaagggggcgucccggcgcagcuggccccucaacgagggcaucauggccgucgggcuggugucccugcucggcagcgcccugcugaagaacgacgugccgcucgccggccccauggucgccgggggccugcugcucgcggccuacgugauguccgggagcagcgccgaccugucccuggagaaggccgccaacgugcagugggacgagauggcggacaucacgggcagcucccccaucaucgaggucaagcaggacgaggacgggagcuucuccauccgggacguggaggagaccaacaugaucacccuccuggugaagcuggcccucaucaccgucagcggccuguacccccuggccaucccggugacgaugacccucugguacauguggcaggugaagacccagcgcuccggcgcccugugggacguccccagccccgccgcgacccagaaggccgcccuguccgaggggguguaccggaucaugcagcgcggccucuucgggaagacccaggugggcgucgggauccacauggagggcguguuccacacgauguggcacgugacccggggcagcgucaucugccacgagaccgggcgccuggagcccuccugggccgacgugcgcaacgacaugaucagcuacggcgggggcuggcggcugggcgacaagugggacaaggaggaggacgugcagguccucgccaucgagccggggaagaaccccaagcacgugcagaccaagcccggccuguucaagacgcugaccggggagaucggcgcggugacccucgacuucaagcccgggaccuccggcagcccgaucaucaaccgcaagggcaaggucaucgggcuguacggcaacgggguggugacgaaguccggcgacuacgucagcgccaucacccaggccgagcggaucggggagcccgacuacgagguggacgaggacaucuuccgcaagaagcggcugaccaucauggaccuccaccccggcgccggcaagaccaagcgcauccugccguccaucgugcgggaggcgcugaagcgccggcugcgcacgcucauccuggcccccacccgggucguggccgccgagauggaggaggcccugcgcgggcuccccauccgguaccagacccccgcggugaagagcgagcacaccggccgcgagaucgucgaccugaugugccacgccacguucaccacccggcugcucuccagcacccgcgugccgaacuacaaccugaucgugauggacgaggcccacuucacggaccccagcuccgucgccgcccggggguacaucagcacccgcguggagaugggcgaggcggccgccaucuucaugaccgccaccccccccggggccacggacccguucccccaguccaacagccccaucgaggacaucgagcgggagauccccgagcgcuccuggaacaccggcuucgacuggaucaccgacuaccagggcaagaccgucugguucgugccgagcaucaaggcggggaacgacaucgccaacugccugcgcaaguccggcaagaaggugauccagcucagccggaagacguucgacaccgaguaccccaagaccaagcugaccgacugggacuucgucgugacgaccgacaucuccgagaugggggccaacuuccgcgccggccgggugaucgacccccgccggugccugaagcccgucauccucaccgacgggccggagcgcgugauccuggcgggccccauccccgugacccccgccagcgccgcccagcggcgcggccggaucgggcgcaacccggcccaggaggacgaccaguacgucuucuccggcgacccccugaagaacgacgaggaccacgcgcacuggacggaggccaagaugcuccuggacaacaucuacacccccgaggggaucauccccacccuguucggcccggagcgggagaagacccaggccaucgacggcgaguuccgccuccggggggagcagcgcaagacguucguggagcugaugcggcgcggcgaccugcccguguggcucagcuacaaggucgccuccgccgggaucagcuacaaggaccgggaguggugcuucaccggcgagcgcaacaaccagauccuggaggagaacauggagguggagaucuggacccgggagggggagaagaagaagcugcgccccaaguggcucgacgcgcggguguacgccgaccccauggcccugcaggacuucaaggaguucgccuccggccgcaagagcaucacccuggacauccucaccgagaucgccucccugccgacguaccugagcucccgcgcgaagcucgcccuggacaacaucgucaugcugcacaccaccgagcggggcgggcgcgccuaccagcacgcccucaacgagcugcccgagagccuggagacccucaugcugguggcgcugcucggcgccaugacggccgggaucuuccuguucuucaugcagggcaaggggaucggcaagcugagcaugggccucaucaccaucgccguggccuccgggcugcugugggucgcggagauccagccccaguggaucgccgccagcaucauccucgaguucuuccugauggugcugcucaucccggagcccgagaagcagcggaccccccaggacaaccagcugaucuacgugauccugaccauccucacgaucaucggccugaucgccgccaacgagauggggcugaucgagaagaccaagaccgacuucggcuucuaccaggucaagaccgagacgaccauccucgacguggaccugcgccccgcguccgccuggacccuguacgccguggccaccacgauccucaccccgaugcugcggcacaccaucgagaacaccagcgccaaccugucccucgcggccaucgccaaccaggccgccguccugauggggcugggcaagggcuggccccuccaccgcauggaccugggggugccccugcucgcgaugggcugcuacagccaggugaaccccacgacccugaccgccucccuggucaugcuccuggugcacuacgccaucaucgggccgggccugcaggccaaggcgacccgggaggcccagaagcgcacggccgccggcaucaugaagaaccccaccguggacgggaucaccgucaucgaccucgagcccaucagcuacgaccccaaguucgagaagcagcugggccaggugaugcugcucgugcugugcgccgggcagcugcuccugaugcggaccacgugggcguucugcgagguccugacccucgccaccggcccgauccugacccugugggaggggaaccccggccgcuucuggaacacgaccaucgccguguccaccgccaacaucuuccggggcagcuaccucgccggggcgggccuggccuucucccugaucaagaacgcccagaccccccgccgggggacgggcaccaccggggagacccucggcgagaaguggaagcgccagcugaacagccuggaccggaaggaguucgaggaguacaagcgcuccggcauccucgagguggaccggaccgaggccaagagcgcccugaaggacggguccaagaucaagcacgcggucagccgcggcuccagcaagauccgguggaucguggagcgcgggauggugaagcccaagggcaaggucguggaccuggggugcggccgcggcgggugguccuacuacauggccacgcucaagaacgugaccgaggucaagggcuacaccaaggggggcccggggcacgaggagcccauccccauggccaccuacggcuggaaccuggugaagcugcacagcggcguggacgucuucuacaagcccacggagcagguggacacccuccugugcgacaucggggagagcuccagcaacccgaccaucgaggagggccggacccugcgcgugcucaagauggucgagcccuggcuguccagcaagcccgaguucugcaucaaggugcugaaccccuacaugccgacggugaucgaggagcuggagaagcuccagcggaagcacgggggcaaccugguccgcugcccccugucccggaacagcacccacgagauguacuggguguccggcgccagcgggaacaucgucuccagcgugaacaccaccuccaagaugcuccugaaccgcuucacgacccggcaccgcaagcccaccuacgagaaggacguggaccugggcgcggggacccggagcgucuccacggagaccgagaagcccgacaugaccaucaucggccgccggcuccagcgccugcaggaggagcacaaggagaccuggcacuacgaccaggagaacccguaccggacgugggccuaccacgggagcuacgaggcccccuccaccggcagcgccuccagcauggugaacggcguggucaagcugcucaccaagcccugggacgugaucccgauggugacccagcuggccaugacggacaccacccccuucgggcagcagcgcgucuucaaggagaagguggacacccggacgccccagcccaagccgggcacccgcauggugaugaccaccacggcgaacuggcugugggcccuccuggggaagaagaagaacccccggcugugcacccgcgaggaguucaucuccaagguccggagcaacgccgccaucggcgccguguuccaggaggagcagggguggaccagcgcguccgaggccgugagcgacucccgcuucugggagcucgucgacaaggagcgggcccugcaccaggagggcaagugcgagagcugcguguacaacaugaugggcaagcgcgagaagaagcugggggaguucggccgcgccaaggggucccgggccaucugguacauguggcucggcgcgcgcuuccuggaguucgaggcccugggguuccucaacgaggaccacugguucggccgggagaacagcugguccggcguggagggggagggccugcaccgccugggguacauccucgaggagaucgacaagaaggacggcgaccugauguacgccgacgacaccgccggcugggacacgcggaucaccgaggacgaccugcagaacgaggagcucaucaccgagcagauggcgccccaccacaagauccuggccaaggccaucuucaagcugaccuaccagaacaaggucgugaaggugcuccgccccaccccgcggggggccgucauggacaucaucagccgcaaggaccagcggggcuccgggcaggugggcacguacgggcugaacaccuucaccaacauggaggugcagcugauccgccagauggaggccgagggcgucaucacccaggacgacaugcagaaccccaagggccucaaggagcggguggagaaguggcugcgcgagugcgggguggaccggcugaagcgcauggcgaucagcggcgacgacugcgucgugaagccccucgacgagcgguucgggacgucccugcuguuccucaacgacaugggcaaggugcgcaaggacaucccccagugggagccgagcaagggguggaagaacuggcaggagguccccuucugcucccaccacuuccacaagaucuucaugaaggacggccggagccugguggugcccugccgcaaccaggacgagcugaucggccgggcccgcaucucccagggggccggcuggagccuccgcgagaccgccugccuggggaaggccuacgcgcagauguggucccugauguacuuccaccggcgcgaccuccggcuggccagcauggccaucugcagcgccguccccaccgagugguucccgaccucccgcacgaccuggagcauccacgcccaccaccaguggaugaccaccgaggacaugcugaagguguggaaccggguguggaucgaggacaaccccaacaugaucgacaagacgcccguccacuccugggaggacauccccuaccucggcaagcgcgaggaccuguggugcgggagccugaucggccucuccagccgggcgaccugggccaagaacauccacaccgccaucacccaggugcgcaaccugaucggcaaggaggaguacguggacuacaugccggucaugaagcgguacuccgcccccagcgaguccgagggggugcuguga

SEQ ID NO: 10428 - RNA, 9867 nt, Artificial Sequence
  derived and/or modified CDS sequence (opt1) from DENV-4__GQ868584__SS-prME
agcaccaucacccugcucugccugauccccacggugauggccuuccaccuguccacccgcgacggcgagccgcucaugaucgucgccaagcacgagcgggggcgcccccugcuguucaagaccaccgagggcaucaacaagugcacgcucaucgcgauggaccugggggagaugugcgaggacaccgugaccuacaagugcccccugcucgugaacaccgagcccgaggacaucgacugcuggugcaaccugacgagcaccugggucauguacggcaccugcacccaguccggggagcggcgccgggagaagcgcagcguggcccugacgccgcacuccggcaugggccucgagacccgggccgagaccuggaugagcuccgagggggccuggaagcacgcccagcgcguggagagcuggauccugcggaaccccggcuucgcgcugcucgccggguucauggccuacaugaucggccagaccgggauccagcgcacggucuucuucgugcugaugaugcugguggcccccuccuacggcaugcggugcgucggcguggggaaccgcgacuucguggagggcgucagcgggggcgcguggguggaccucgugcuggagcacggcgggugcgucaccaccauggcccagggcaagcccacccuggacuucgagcucacgaagaccaccgccaaggagguggcccugcugcggaccuacugcaucgaggcccucaucuccaacaucacgaccgcgacccgcugcccgacccagggggagcccuaccugaaggaggagcaggaccggcaguacaucugccgccgggacguggucgaccgcggcugggggaacggcugcggccuguucgggaagggcgggguggugacgugcgccaaguucagcugcuccggcaagaucaccgggaaccucguccagaucgagaaccuggaguacaccgugguggucaccgugcacaacggcgacacgcacgccgucggcaacgacaccagcaaccacggggugaccgccaccaucacgccccggucccccagcguggaggucaagcugccggacuacggcgagcucacccuggacugcgagccccgcuccgggaucgacuucaacgagaugauccugaugaagaugaagaagaagaccuggcucgugcacaagcagugguuccuggaccugccccuccccuggaccaccggcgccgacacgagcgaggugcacuggaacuacaaggagcggauggucaccuucaaggugccgcacgcgaagcgccaggacgugaccguccuggggucccaggagggcgccaugcacagcgcccuggccggcgccaccgagguggacagcggggacggcaaccacauguucgcggggcaccucaagugcaaggugcgcauggagaagcugcggaucaagggcauguccuacacgaugugcagcggcaaguucuccaucgacaaggagauggccgagacccagcacgggaccaccgucgugaaggugaaguacgagggcgccggggcccccugcaagguccccaucgagauccgcgacgugaacaaggagaagguggucggccgggugaucagcgccacgccccuggcggagaacaccaacuccgugaccaacaucgagcucgagccgcccuucggggacagcuacaucaugaucggcgucggcaacuccgcccugacccugcacugguuccgcaaggggagcuccaucggcaagauguucgagagcacguaccggggggccaagcgcauggccauccucggcgagaccgcgugggacuucggguccgugggcggccuguucaccagccuggggaaggccgugcaccaggucuucggcuccguguacaccacgauguucgggggcgugagcuggaugauccggauccucaucggguuccugguccuguggaucggcaccaacucccgcaacaccagcauggccaugaccugcaucgccgugggcgggaucacgcuguuccucggcuucaccgugcaggccgacauggggugcgucguguccuggagcggccgggagcugaagugcggguccggcaucuucguggucgacaacgugcacaccuggaccgagcaguacaaguuccagcccgagagccccgcgcgccuggccagcgccauccucaacgcccacaaggacggcgugugcgggauccgguccacgacccgccuggagaacgucauguggaagcagaucaccaacgagcugaacuacgugcucugggagggcgggcacgaccugaccguggucgccggcgacgugaagggcgugcugacgaaggggaagcgggcgcucgccccgcccgccagcgaccugaaguacuccuggaagaccuggggcaaggccaagaucuucacccccgaggcccgcaacagcaccuuccugaucgacgggcccgacacguccgagugcccgaacgagcggcgcgcguggaacagcuucgaggucgaggacuacggcuucgggauguucaccaccaacaucuggaugaaguuccgggagggcuccagcgaggugugcgaccaccgccucauguccgccgccaucaaggaccagaaggccgugcacgcggacaugggcuacuggaucgagagcuccaagaaccagaccuggcagaucgagcgggccagccugaucgaggucaagacgugccuguggcccaagacccacacccucugguccaacggggugcuggagagccagaugcugauccccaaguccuacgccggcccguucagccagcacaacuaccgccagggguacgccacccagaccgugggccccuggcaccucgggaagcuggagaucgacuucggcgagugccccggcacgaccgucaccauccaggaggacugcgaccaccgcgggcccucccugcggaccacgaccgccagcggcaagcucgugacccaguggugcugccgcagcugcaccaugccgccccugcgguuccugggggaggacggcugcugguacgggauggagauccgcccccucuccgagaaggaggagaacauggugaagagccaggucacggcgggccagggcaccuccgagaccuucagcauggggcugcugugccucacccuguucguggaggagugccugcggcgccgggucacgcgcaagcacaugauccucgccguggugaucacccugugcgccaucauccugggcgggcucaccuggauggaccugcugcgggcccucaucaugcugggcgacaccauguccggccgcaucgggggccagacgcaccuggccaucauggcggucuucaagaugagccccggguacgugcucggcguguuccugcggaagcugaccucccgcgagaccgcccucauggucaucgggauggccaugaccacgacccugagcaucccgcacgaccugauggagcucaucgacggcaucucccugggccugauccuccugaagaucgugacccaguucgacaacacccagguggggacgcuggcccucagccugaccuucauccgguccaccaugagccuggucauggccuggcgcaccaucauggcggugcucuucguggucacgcugaucccccugugccggaccuccugccuccagaagcagagccacuggguggagaucaccgcccugauccugggcgcccaggcccuccccguguaccugaugacccugaugaagggggcgucccgccggagcuggccccucaacgagggcaucauggccgucgggcuggugucccugcucggcagcgcccugcugaagaacgacgugccgcucgccggccccauggucgccgggggccugcugcucgcggccuacgugauguccgggagcagcgccgaccugucccuggagaaggccgccaacgugcagugggacgagauggcggacaucacgggcagcucccccaucaucgaggucaagcaggacgaggacgggagcuucuccauccgcgacguggaggagaccaacaugaucacccuccuggugaagcuggcccucaucaccgucagcggccuguacccccuggccaucccggugacgaugacccucugguacauguggcaggugaagacccagcgguccggcgcccugugggacguccccagccccgccgcgacccagaaggccgcccuguccgaggggguguaccgcaucaugcagcggggccucuucgggaagacccaggugggcgucgggauccacauggagggcguguuccacacgauguggcacgugacccgcggcagcgucaucugccacgagaccgggcgccuggagcccuccugggccgacgugcggaacgacaugaucagcuacggcgggggcuggcgccugggcgacaagugggacaaggaggaggacgugcagguccucgccaucgagccggggaagaaccccaagcacgugcagaccaagcccggccuguucaagacgcugaccggggagaucggcgcggugacccucgacuucaagcccgggaccuccggcagcccgaucaucaaccggaagggcaaggucaucgggcuguacggcaacgggguggugacgaaguccggcgacuacgucagcgccaucacccaggccgagcgcaucggggagcccgacuacgagguggacgaggacaucuuccggaagaagcgccugaccaucauggaccuccaccccggcgccggcaagaccaagcggauccugccguccaucgugcgcgaggcgcugaagcggcgccugcggacgcucauccuggcccccacccgcgucguggccgccgagauggaggaggcccugcgggggcuccccauccgcuaccagacccccgcggugaagagcgagcacaccggccgggagaucgucgaccugaugugccacgccacguucaccacccgccugcucuccagcacccgggugccgaacuacaaccugaucgugauggacgaggcccacuucacggaccccagcuccgucgccgcccgcggguacaucagcacccggguggagaugggcgaggcggccgccaucuucaugaccgccaccccccccggggccacggacccguucccccaguccaacagccccaucgaggacaucgagcgcgagauccccgagcgcuccuggaacaccggcuucgacuggaucaccgacuaccagggcaagaccgucugguucgugccgagcaucaaggcggggaacgacaucgccaacugccugcggaaguccggcaagaaggugauccagcucagccgcaagacguucgacaccgaguaccccaagaccaagcugaccgacugggacuucgucgugacgaccgacaucuccgagaugggggccaacuuccgggccggccgcgugaucgacccccggcgcugccugaagcccgucauccucaccgacgggccggagcgggugauccuggcgggccccauccccgugacccccgccagcgccgcccagcgccggggccgcaucgggcggaacccggcccaggaggacgaccaguacgucuucuccggcgacccccugaagaacgacgaggaccacgcgcacuggacggaggccaagaugcuccuggacaacaucuacacccccgaggggaucauccccacccuguucggcccggagcgcgagaagacccaggccaucgacggcgaguuccggcuccgcggggagcagcggaagacguucguggagcugaugcgccggggcgaccugcccguguggcucagcuacaaggucgccuccgccgggaucagcuacaaggaccgcgaguggugcuucaccggcgagcggaacaaccagauccuggaggagaacauggagguggagaucuggacccgcgagggggagaagaagaagcugcggcccaaguggcucgacgcgcgcguguacgccgaccccauggcccugaaggacuucaaggaguucgccuccggccgcaagagcaucacccuggacauccucaccgagaucgccucccugccgacguaccugagcucccgggcgaagcucgcccuggacaacaucgucaugcugcacaccaccgagcgcggcgggcgggccuaccagcacgcccucaacgagcugcccgagagccuggagacccucaugcugguggcgcugcucggcgccaugacggccgggaucuuccuguucuucaugcagggcaaggggaucggcaagcugagcaugggccucaucaccaucgccguggccuccgggcugcugugggucgcggagauccagccccaguggaucgccgccagcaucauccucgaguucuuccugauggugcugcucaucccggagcccgagaagcagcgcaccccccaggacaaccagcugaucuacgugauccugaccauccucacgaucaucggccugaucgccgccaacgagauggggcugaucgagaagaccaagaccgacuucggcuucuaccaggucaagaccgagacgaccauccucgacguggaccugcggcccgcguccgccuggacccuguacgccguggccaccacgauccucaccccgaugcugcgccacaccaucgagaacaccagcgccaaccugucccucgcggccaucgccaaccaggccgccguccugauggggcugggcaagggcuggccccuccaccggauggaccugggggugccccugcucgcgaugggcugcuacagccaggugaaccccacgacccugaccgccucccuggucaugcuccuggugcacuacgccaucaucgggccgggccugcaggccaaggcgacccgcgaggcccagaagcggacggccgccggcaucaugaagaaccccaccguggacgggaucaccgucaucgaccucgagcccaucagcuacgaccccaaguucgagaagcagcugggccaggugaugcugcucgugcugugcgccgggcagcugcuccugaugcgcaccacgugggcguucugcgagguccugacccucgccaccggcccgauccugacccugugggaggggaaccccggccgguucuggaacacgaccaucgccguguccaccgccaacaucuuccgcggcagcuaccucgccggggcgggccuggccuucucccugaucaagaacgcccagaccccccggcgcgggacgggcaccaccggggagacccucggcgagaaguggaagcggcagcugaacagccuggaccgcaaggaguucgaggaguacaagcgguccggcauccucgagguggaccgcaccgaggccaagagcgcccugaaggacggguccaagaucaagcacgcggucagccggggcuccagcaagauccgcuggaucguggagcgcgggauggugaagcccaagggcaaggucguggaccuggggugcggccggggcgggugguccuacuacauggccacgcucaagaacgugaccgaggucaagggcuacaccaaggggggcccggggcacgaggagcccauccccauggccaccuacggcuggaaccuggugaagcugcacagcggcguggacgucuucuacaagcccacggagcagguggacacccuccugugcgacaucggggagagcuccagcaacccgaccaucgaggagggccgcacccugcgggugcucaagauggucgagcccuggcuguccagcaagcccgaguucugcaucaaggugcugaaccccuacaugccgacggugaucgaggagcuggagaagcuccagcgcaagcacgggggcaaccugguccggugcccccugucccgcaacagcacccacgagauguacuggguguccggcgccagcgggaacaucgucuccagcgugaacaccaccuccaagaugcuccugaaccgguucacgacccgccaccggaagcccaccuacgagaaggacguggaccugggcgcggggacccgcagcgucuccacggagaccgagaagcccgacaugaccaucaucggccggcgccuccagcggcugcaggaggagcacaaggagaccuggcacuacgaccaggagaacccguaccgcacgugggccuaccacgggagcuacgaggcccccuccaccggcagcgccuccagcauggugaacggcguggucaagcugcucaccaagcccugggacgugaucccgauggugacccagcuggccaugacggacaccacccccuucgggcagcagcgggucuucaaggagaagguggacacccgcacgccccagcccaagccgggcacccggauggugaugaccaccacggcgaacuggcugugggcccuccuggggaagaagaagaacccccgccugugcacccgggaggaguucaucuccaagguccgcagcaacgccgccaucggcgccguguuccaggaggagcagggguggaccagcgcguccgaggccgugagcgacucccgguucugggagcucgucgacaaggagcgcgcccugcaccaggagggcaagugcgagagcugcguguacaacaugaugggcaagcgcgagaagaagcugggggaguucggccgggccaaggggucccgcgccaucugguacauguggcucggcgcgcgguuccuggaguucgaggcccugggguuccucaacgaggaccacugguucggccgcgagaacagcugguccggcguggagggggagggccugcaccggcugggguacauccucgaggagaucgacaagaaggacggcgaccugauguacgccgacgacaccgccggcugggacacgcgcaucaccgaggacgaccugcagaacgaggagcucaucaccgagcagauggcgccccaccacaagauccuggccaaggccaucuucaagcugaccuaccagaacaaggucgugaaggugcuccggcccaccccgcgcggggccgucauggacaucaucagccggaaggaccagcgcggcuccgggcaggugggcacguacgggcugaacaccuucaccaacauggaggugcagcugauccggcagauggaggccgagggcgucaucacccaggacgacaugcagaaccccaagggccucaaggagcgcguggagaaguggcugcgggagugcgggguggaccgccugaagcggauggcgaucagcggcgacgacugcgucgugaagccccucgacgagcgcuucgggacgucccugcuguuccucaacgacaugggcaaggugcggaaggacaucccccagugggagccgagcaagggguggaagaacuggcaggagguccccuucugcucccaccacuuccacaagaucuucaugaaggacggccgcagccugguggugcccugccggaaccaggacgagcugaucggccgcgcccgcaucucccagggggccggcuggagccuccgggagaccgccugccuggggaaggccuacgcgcagauguggucccugauguacuuccaccgccgggaccuccgccuggccagcauggccaucugcagcgccguccccaccgagugguucccgaccucccggacgaccuggagcauccacgcccaccaccaguggaugaccaccgaggacaugcugaagguguggaaccgcguguggaucgaggacaaccccaacaugaucgacaagacgcccguccacuccugggaggacauccccuaccucggcaagcgggaggaccuguggugcgggagccugaucggccucuccagccgcgcgaccugggccaagaacauccacaccgccaucacccaggugcggaaccugaucggcaaggaggaguacguggacuacaugccggucaugaagcgcuacuccgcccccagcgaguccgagggggugcuguga

SEQ ID NO: 10429 - RNA, 9867 nt, Artificial Sequence
  derived and/or modified CDS sequence (opt1) from DENV-4__GQ868585__SS-prME
agcaccaucacccugcucugccugauccccaccgugauggccuuccaccuguccacccgcgacggcgagccccucaugaucguggccaagcacgagcgggggcgcccccugcuguucaagaccaccgagggcaucaacaagugcacgcucaucgccauggaccugggggagaugugcgaggacaccgugaccuacaagugcccccugcucgugaacaccgagcccgaggacaucgacugcuggugcaaccugacgagcaccugggugauguacgggaccugcacccaguccggggagcggcgccgggagaagcgcagcguggcccugacgccgcacuccggcaugggccucgagacccgggccgagaccuggaugagcuccgagggggccuggaagcacgcccagcgcguggagagcuggauccugcggaaccccggcuucgcgcugcucgccggguucauggccuacaugaucggccagaccgggauccagcgcacgguguucuucgugcugaugaugcugguggcccccuccuacggcaugcggugcgucggcguggggaaccgcgacuucguggagggcgucagcgggggcgcguggguggaccucgugcuggagcacggcgggugcgucaccaccauggcccagggcaagcccacccuggacuucgagcucacgaagaccaccgccaaggagguggcccugcugcggaccuacugcaucgaggcccucaucuccaacaucacgaccgcgacccgcugcccgacccagggggagcccuaccugaaggaggagcaggaccagcaguacaucugccggcgcgacguggucgaccggggcugggggaacggcugcggccuguucgggaagggcgggguggugacgugcgccaaguucagcugcuccggcaagaucaccgggaaccucguccagaucgagaaccuggaguacaccgugguggucaccgugcacaacggcgacacgcacgccgucggcaacgacaccagcaaccacggggugaccgccaccaucacgccccgcucccccagcguggaggucaagcugccggacuacggcgagcucacccuggacugcgagccccgguccgggaucgacuucaacgagaugauccugaugaagaugaagaagaagaccuggcucgugcacaagcagugguuccuggaccugccccuccccuggaccaccggcgccgacacgagcgaggugcacuggaacuacaaggagcgcauggucaccuucaaggugccgcacgcgaagcggcaggacgugaccguccuggggucccaggagggcgccaugcacagcgcccuggccggcgccaccgagguggacagcggggacgagaaccacauguucgcgggccaccucaagugcaaggugcgcauggagaagcugcgcaucaaggggauguccuacacgaugugcagcggcaaguucuccaucgacaaggagauggccgagacccagcacggcaccaccgucgugaaggugaaguacgagggggccggcgcccccugcaagguccccaucgagauccgggacgugaacaaggagaagguggucgggcgcgugaucagcgccacgccccuggcggagaacaccaacuccgugaccaacaucgagcucgagccgcccuucggcgacagcuacaucgucaucggggugggcaacuccgcccugacccugcacugguuccggaagggcagcuccaucgggaagauguucgagagcacguaccgcggcgccaagcggauggccauccucggggagaccgcgugggacuucggcuccgucggcgggcuguucaccagccuggggaaggccguccaccagguguucggguccguguacaccacgauguucggcggggucagcuggaugauccgcauccucaucggcuuccuggugcuguggaucgggaccaacucccggaacaccagcauggccaugaccugcaucgccgugggcggcaucacgcuguuccucggguucaccguccaggccgacaugggcugcgugguguccuggagcgggcgcgagcugaagugcggcuccgggaucuucgucguggacaacgugcacaccuggaccgagcaguacaaguuccagcccgagagccccgcgcggcuggccagcgccauccucaacgcccacaaggacggcgucugcggcauccgcuccacgacccggcuggagaacgugauguggaagcagaucaccaacgagcugaacuacgugcucugggagggcgggcacgaccugaccgucguggccggggacgugaagggcguccugacgaagggcaagcgcgcgcucaccccgcccgccagcgaccugaaguacuccuggaagaccugggggaaggccaagaucuucacccccgaggcccggaacagcacguuccugaucgacggccccgacaccuccgagugcccgaacgagcgccgggccuggaacagcuucgagguggaggacuacggguucggcauguucaccaccaacaucuggaugaaguuccgcgagggguccagcgaggugugcgaccaccggcucauguccgcggccaucaaggaccagaaggccguccacgccgacaugggcuacuggaucgagagcuccaagaaccagacguggcagaucgagcgcgcgagccugaucgaggugaagaccugccuguggcccaagacccacacccucugguccaacggcgugcuggagagccagaugcugauccccaaguccuacgccgggccguucagccagcacaacuaccggcagggcuacgccacccagacggucgggcccuggcaccucggcaagcuggagaucgacuucggggagugccccggcaccaccgugaccauccaggagaacugcgaccaccgcggccccucccugcgcacgaccaccgccagcgggaagcucgugacccaguggugcugccggagcugcacgaugccgccccugcgcuuccugggcgaggacgggugcugguacggcauggagauccggccccucuccgagaaggaggagaacauggucaagagccaggugaccgccgggcagggcaccuccgagaccuucagcaugggccugcugugccucacgcuguucgucgaggagugccugcgccggcgcgugacccggaagcacaugauccucgcgguggucaucacccugugcgccaucauccucgggggccucaccuggauggaccugcugcgcgcccucaucaugcugggggacacgauguccggccggaucggcgggcagacccaccuggccaucauggccguguucaagaugagccccggcuacgugcucggggucuuccugcgcaagcugaccucccgggagaccgcgcucauggugaucggcauggccaugacgaccacccugagcaucccgcacgaccugauggagcucaucgacgggaucucccugggccugauccuccugaagaucgugacccaguucgacaacacgcaggucggcacccuggcccucagccugaccuucauccgcuccaccaugagccuggugauggccuggcggacgaucauggccgugcuguucgucgugacccugaucccccugugccgcaccuccugccuccagaagcagagccacuggguggagaucaccgcgcugauccugggggcccaggcccuccccgucuaccugaugacgcugaugaagggcgccucccggcgcagcuggccccucaacgaggggaucauggcggugggccuggugucccugcucgggagcgcccugcugaagaacgacgucccgcucgccggccccaugguggccggcgggcugcugcucgccgcguacgugauguccggcagcagcgccgaccugucccuggagaaggccgccaacguccagugggacgagauggccgacaucaccgggagcucccccaucaucgaggugaagcaggacgaggacggcagcuucuccauccgggacguggaggagaccaacaugaucacccuccuggucaagcuggcgcucaucacggugagcgggcuguacccccuggccaucccgaucaccaugacccucugguacauguggcaggucaagacccagcgcuccggcgcccugugggacguccccagccccgccgccacccagaaggcggcccuguccgagggcguguaccggaucaugcagcgcggccucuucggcaagacccaggugggggucggcauccacauggaggggguguuccacaccauguggcacgugacccggggcagcgucaucugccacgagaccggccgccuggagcccuccugggccgacgugcgcaacgacaugaucagcuacgggggcggguggcggcugggcgacaagugggacaaggaggaggacgugcagguccucgccaucgagccgggcaagaaccccaagcacgugcagacgaagcccgggcuguucaagacccugaccggcgagaucggggccgugacccucgacuucaagcccggcacguccgggagcccgaucaucaaccgcaagggcaaggucaucggccuguacgggaacggcguggugaccaaguccggggacuacgucagcgcgaucacccaggccgagcggaucggcgagcccgacuacgagguggacgaggacaucuuccgcaagaagcggcugaccaucauggaccuccaccccggggccggcaagacgaagcgcauccugccguccaucgugcgggaggcccugaagcgccggcugcgcacccucauccuggcgcccacccgggucguggccgccgagauggaggaggcccugcgcggccuccccauccgguaccagacccccgccgucaagagcgagcacacggggcgcgagaucgucgaccugaugugccacgcgaccuucaccacccggcugcucuccagcacgcgcgugccgaacuacaaccugaucgugauggacgaggcccacuucaccgaccccagcuccgucgccgcccggggcuacaucagcacccgcguggagaugggggaggccgcggccaucuucaugaccgccacgccgcccggcgccaccgacccguucccccaguccaacagccccaucgaggacaucgagcgggagauccccgagcgcuccuggaacaccggguucgacuggaucaccgacuaccagggcaagacggucugguucgugccgagcaucaaggccggcaacgacaucgcgaacugccugcgcaaguccgggaagaaggugauccagcucagccggaagaccuucgacaccgaguaccccaagaccaagcugacggacugggacuucgucgugaccaccgacaucuccgagaugggcgccaacuuccgcgccgggcgggugaucgacccccgccggugccugaagcccgucauccucaccgacggcccggagcgcgugauccuggccgggcccauccccgugacgcccgcgagcgccgcccagcggcgcggccggaucggccgcaacccggcccaggaggacgaccaguacgucuucuccggggacccccugaagaacgacgaggaccacgcccacuggaccgaggcgaagaugcuccuggacaacaucuacacccccgagggcaucauccccacccuguucgggccggagcgggagaagacgcaggccaucgacggcgaguuccgccuccggggcgagcagcgcaagaccuucguggagcugaugcggcgcggggaccugcccguguggcucagcuacaaggucgccuccgccggcaucagcuacaaggaccgggaguggugcuucaccggggagcgcaacaaccagauccuggaggagaacauggagguggagaucuggacccgggagggcgagaagaagaagcugcgccccaaguggcucgacgcccggguguacgcggaccccauggcccugaaggacuucaaggaguucgccuccgggcgcaagagcaucacccuggacauccucacggagaucgccucccugccgaccuaccugagcucccgcgccaagcucgcgcuggacaacaucgucaugcugcacaccaccgagcggggcggccgcgccuaccagcacgcccucaacgagcugcccgagagccuggagacgcucaugcugguggcccugcucggggcgaugaccgccggcaucuuccuguucuucaugcaggggaagggcaucgggaagcugagcaugggccucaucaccaucgccguggccuccggccugcugugggucgccgagauccagccccaguggaucgcggccagcaucauccucgaguucuuccugauggugcugcucaucccggagcccgagaagcagcggacgccccaggacaaccagcugaucuacgugauccugacgauccucaccaucaucgggcugaucgccgccaacgagaugggccugaucgagaagaccaagaccgacuucggguucuaccaggucaagacggagaccaccauccucgacguggaccugcgccccgccuccgcguggacccuguacgccguggccacgaccauccucaccccgaugcugcggcacaccaucgagaacacgagcgccaaccugucccucgccgcgaucgccaaccaggccgccguccugaugggccuggggaagggcuggccccuccaccgcauggaccugggcgugccccugcucgccauggggugcuacagccaggugaaccccaccacccugaccgcgucccuggucaugcuccuggugcacuacgccaucaucggcccggggcugcaggccaaggccacgcgggaggcgcagaagcgcaccgccgccggcaucaugaagaaccccaccguggacggcaucaccgucaucgaccucgagcccaucagcuacgaccccaaguucgagaagcagcugggccaggugaugcugcucgugcugugcgccggccagcugcuccugaugcggacgaccugggccuucugcgagguccugacccucgcgaccgggccgauccugacgcugugggagggcaaccccgggcgcuucuggaacaccaccaucgccguguccaccgccaacaucuuccggggcagcuaccucgccggcgccgggcuggcguucucccugaucaagaacgcccagacgccccgccggggcaccgggaccaccggcgagacccucggggagaaguggaagcgccagcugaacagccuggaccggaaggaguucgaggaguacaagcgcuccggcauccucgagguggaccggacggaggccaagagcgcccugaaggacggcuccaagaucaagcacgccgucagccgcggguccagcaagauccgguggaucguggagcgcggcauggugaagcccaaggggaaggucaucgaccugggcugcgggcgcggcggcugguccuacuacauggcgacccucaagaacgugaccgaggugaagggguacaccaagggcgggccgggccacgaggagcccauccccauggccacguacggguggaaccuggucaagcugcacagcggcguggacguguucuacaagcccaccgagcaggucgacacccuccugugcgacaucggcgagagcuccagcaacccgaccaucgaggaggggcggacgcugcgcgugcucaagaugguggagcccuggcuguccagcaagcccgaguucugcaucaagguccugaaccccuacaugccgaccgugaucgaggagcuggagaagcuccagcggaagcacggcgggaaccuggugcgcugcccccugucccggaacagcacccacgagauguacugggucuccggcgccagcggcaacaucguguccagcgucaacaccacguccaagaugcuccugaaccgcuucaccacccggcaccgcaagcccaccuacgagaaggacguggaccugggggccggcacgcggagcguguccaccgagaccgagaagcccgacaugaccaucaucgggcgccggcuccagcgccugcaggaggagcacaaggagacguggcacuacgaccaggagaacccguaccggaccugggcguaccacggcagcuacgaggcccccuccaccgggagcgccuccagcauggucaacggcguggugaagcugcucaccaagcccugggacgucaucccgauggugacgcagcuggccaugaccgacaccacccccuucggccagcagcgcguguucaaggagaaggucgacacgcggacgccccagcccaagccggggacccgcauggugaugaccacgaccgccaacuggcugugggcgcuccugggcaagaagaagaacccccggcugugcacccgcgaggaguucaucuccaaggugcggagcaacgccgccaucggggccgucuuccaggaggagcagggcuggaccagcgccuccgaggcggugaacgacagccgcuucugggagcucguggacaaggagcgggcccugcaccaggaggggaagugcgaguccugcgucuacaacaugaugggcaagcgcgagaagaagcugggcgaguucgggcgcgccaagggcagccgggccaucugguacauguggcucggggcccgcuuccuggaguucgaggcgcugggcuuccucaacgaggaccacugguucgggcgggagaacuccuggagcggcguggagggcgaggggcugcaccgccugggcuacauccucgaggagaucgacaagaaggacggggaccugauguacgccgacgacacggccggcugggacacccggaucaccgaggacgaccugcagaacgaggagcucaucaccgagcagauggcgccccaccacaagauccuggcgaaggccaucuucaagcugaccuaccagaacaagguggucaaggugcuccgccccacgccgcggggcgccgugauggacaucaucucccgcaaggaccagcgggggagcggccaggucgggaccuacggccugaacaccuucaccaacauggaggugcagcugauccgccagauggaggccgagggggugaucacgcaggacgacaugcagaaccccaagggccucaaggagcgggucgagaaguggcugcgcgagugcggcguggaccggcugaagcgcauggccaucuccggggacgacugcguggucaagccccucgacgagcgguucggcaccagccugcuguuccucaacgacauggggaaggugcgcaaggacaucccccagugggagccguccaagggcuggaagaacuggcaggaggugcccuucugcagccaccacuuccacaagaucuucaugaaggacgggcggucccuggucgugcccugccgcaaccaggacgagcugaucggccgggcgcgcaucagccagggcgccggguggucccuccgcgagaccgccugccugggcaaggccuacgcccagauguggagccugauguacuuccaccggcgcgaccuccggcuggcguccauggccaucugcagcgccgugcccaccgagugguucccgacgagccgcaccaccugguccauccacgcccaccaccaguggaugaccacggaggacaugcugaaggucuggaaccggguguggaucgaggacaaccccaacaugaucgacaagacccccgugcacagcugggaggacauccccuaccucgggaagcgcgaggaccuguggugcggcucccugaucgggcucagcucccgggccaccugggcgaagaacauccacaccgccaucacgcagguccgcaaccugaucggcaaggaggaguacguggacuacaugccggugaugaagcgguacagcgcccccuccgagagcgagggcguccuguga

SEQ ID NO: 10430 - RNA, 9867 nt, Artificial Sequence
  derived and/or modified CDS sequence (opt1) from DENV-4__JQ922560__SS-prME
agcaccaucacccugcucugccugauccccaccgugauggccuuccaccuguccacccgggacggggagccgcucaugaucguggccaagcacgagcgggggcgccggcugcuguucaagaccaccgaggggaucaacaagugcacccucaucgccauggaccugggggagaugugcgaggacaccgugaccuacaagugcccccugcucgugaacaccgagcccgaggacaucgacugcuggugcaaccugaccagcgccugggugauguacgggaccugcacccaguccggggagcgccggcgcgagaagcggagcguggcccugacgccccacuccggcaugggccucgagacccgcgccgagaccuggaugagcuccgagggggccuggaagcacgcccagcggguggagagcuggauccugcgcaacccgggcuucgcccugcucgccggguucauggccuacaugaucggccagaccgggauccagcggaccguguucuucauccugaugaugcugguggcgcccuccuacggcaugcgcugcgugggcguggggaaccgggacuucguggagggcgugagcgggggcgccugggucgaccucgugcuggagcacggcgggugcgugaccaccauggcccagggcaagcccacccuggacuucgagcucaucaagaccacggccaaggaggucgcccugcugcgcaccuacugcaucgaggcguccaucagcaacaucaccaccgccacgcggugccccacccagggggagccguaccucaaggaggagcaggaccagcaguacaucugccgccgggacgugguggaccgcggcugggggaacggcugcggccuguucgggaagggcggggucgugaccugcgccaaguucuccugcaccggcaagaucacggggaaccugauccagaucgagaaccucgaguacaccguggucgugaccgugcacaacggcgacacccacgccgucggcaacgacacgagcaaccacggggugaccgccaccaucacgccccggucccccagcgucgagguggagcugcccgacuacggcgagcugacgcucgacugcgagccgcgcuccgggaucgacuucaacgagaugauccugaugaagaugaacaagaagaccuggcuggugcacaagcagugguuccucgaccugccccugcccugggcggccggcgccgacaccagcgagguccacuggaaccacaaggagcggauggugaccuucaaggugccccacgccaagcgccaggacgucaccgugcucgggucccaggagggcgccaugcacagcgcgcugacgggcgccaccgagguguacagcggggacggcaaccugauguucgccgggcaccucaagugcaagguccgcauggagaagcugcggaucaagggcauguccuacaccaugugcagcggcaaguucuccaucgacaaggagauggccgagacccagcacgggacgaccguggugaaggucaaguacgagggcgccggggcgccgugcaaggugcccaucgagauccgcgacgugaacaaggagaaggucgugggccgggugaucagcuccacccccuucgccgagaacaccaacagcgucacgaacaucgagcuggagcccccguucggggacuccuacaucgugaucggcgugggcgacagcgcccucacccugcacugguucaccaagggguccagcaucggcaagauguucgaguccaccuaccgcggggccaagcggauggcgauccugggcgagacggccugggacuucgggagcgucggcggccuccugaccucccuggggaaggccgugcaccagguguucggcagcgucuacaccaccauguucgggggcguguccuggauggugcgcauccucaucggguuccugguccuguggaucggcacgaacagccggaacaccuccauggccaugagcugcaucgccgugggcgggaucacccuguuccucggcuucaccgugcacgcggacauggggugcgccgucuccuggagcggcaaggagcugaagugcgggagcggcaucuucaucaucgacaacgugcacacguggaccgagcaguacaaguuccagcccgagucccccgcccgccuggccagcgccauccucaacgcgcacaaggacggcgugugcgggauccgguccaccacccgccuggagaacgucauguggaagcagaucacgaacgagcugaacuacgugcucugggagggcgggcacgaccugaccguggucgccggcgacgugaagggcgugcugagcaaggggaagcgggcccucgcgccgcccgucaacgaccugaaguacuccuggaagaccuggggcaaggccaagaucuucacccccgagacgcgcaacagcaccuuccugaucgacgggcccgacaccuccgagugccccaacgagcggcgcgcguggaacuuccucgagguggaggacuacggcuucgggauguucaccacgaacaucuggaugaaguuccgggagggcagcuccgagaugugcgaccaccgccugaugagcgccgccaucaaggaccagaaggccgugcacgcggacaugggcuacuggaucgaguccagcaagaaccagaccuggcagaucgagaaggccucccugaucgaggucaagaccugccucuggcccaagacccacacgcuguggagcaacggggugcuggagucccagaugcucauccccaaggccuacgccggccccuucagccagcacaacuaccggcagggguacgccacccagaccgugggcccguggcaccuggggaagcuggagaucgacuucggcgagugccccggcaccaccgucacgauccaggaggacugcgaccaccgcgggcccucccuccggaccaccaccgcgagcggcaagcuggugacgcaguggugcugccgcagcugcaccaugcccccgcugcgcuuccucggggaggacggcugcugguacgggauggagauccggccccuguccgagaaggaggagaacauggucaagagccaggucuccgccggccagggcaccagcgagaccuucuccauggggcugcucugccugacgcuguucguggaggagugccuccgccggcgcgugacccggaagcacaugauccuggucguggucaccacccugugcgccaucauccucggcgggcugacguggauggaccugcuccgcgcccugaucaugcugggcaacaccaugagcucccggaugggcgggcagauccaccucgccaucauggcgguguucaagaugagccccggcuacgugcuggggaucuuccugcgcaagcucaccucccgggagaccgcccugauggucaucggcauggccaugacgaccgugcugagcaucccccacgaccucauggaguucguggacgggaucucccugggccugauccuccugaagauggucacccacuucgacaacacccaggugggcacgcuggcccucagccugaccuucaucaaguccaccaugccgcuggugauggccuggcgcaccaucauggcgguccucuucguggugacgcugaucccccugugccggaccagcugccuccagaagcagucccacugggucgagaucaccgcccugauccugggggcccaggcccuccccguguaccugaugacccugaugaagggcgcgagcaagcgcuccuggccccucaacgaggggaucauggccgugggccuggucagccugcucggguccgcccugcugaagaacgacgugccgcucgccggccccaugguggccggcgggcugcugcucgcggccuacgucaugagcggcagcuccgccgaccugagccuggagaaggccgccacggugcagugggacgagauggcggacaucaccggguccagccccaucaucgaggugaagcaggacgaggacggcuccuucagcauccgggacgucgaggagaccaacaugaucacccuccuggugaagcuggcccucaucacgguguccgggcuguacccccuggccaucccggucaccaugacccucugguacauguggcaggucaagacccagcgcagcggcgcccugugggacgugcccucccccgccgcggcccagaaggccacgcugaccgagggcgucuaccggaucaugcagcgcggccucuucggcaagacccaggugggggugggcauccacauggagggggucuuccacaccauguggcacgugacccggggcagcgugaucugccacgaguccggccgccuggagcccagcugggccgacguccggaacgacaugaucuccuacgggggcggguggcgccugggcgacaagugggacaaggaggaggacguccaggugcucgccgucgagccgggcaagaaccccaagcacgugcagacgaagcccgggcuguucaagacccugaccggcgagaucggggcggugacccucgacuucaagcccggcacgagcggguccccgaucaucaaccggaagggcaaggucaucggccuguacgggaacggcguggugaccaagagcggggacuacgucuccgccaucacccaggccgagcgcaucggcgagcccgacuacgagguggacgaggacaucuuccgcaagaagcggcugaccaucauggaccuccaccccggggccggcaagacgaagcgcauccugccgagcaucgugcgggaggcgcugaagcgccggcugcgcacccucauccuggcccccacccgggucguggccgccgagauggaggaggcccugcgcggccuccccauccgguaccagacccccgcggugaaguccgagcacacggggcgcgagaucgucgaccugaugugccacgccaccuucaccacccggcugcucagcagcacgcgcgugccgaacuacaaccugaucgugauggacgaggcccacuucaccgaccccuccagcgucgccgcccggggcuacaucuccacccgcguggagaugggggaggcggccgccaucuucaugaccgccacgccgcccggcaccaccgacccguucccccagagcaacucccccaucgaggacaucgagcgggagauccccgagcgcagcuggaacaccggguucgacuggaucacggacuaccagggcaagaccgucugguucgugccguccaucaaggccggcaacgacaucgcgaacugccugcgcaagagcgggaagaaggugguccagcucucccgcaagaccuucgacaccgaguaccccaagacgaagcugaccgacugggacuucguggugaccaccgacaucagcgagaugggcgccaacuuccgggccgggcgcgucaucgacccccgccggugccugaagcccgugaucaucacggacggcccggagcgcgugauccucgccgggcccauccccgucacccccgcguccgccgcccagcggcgcggccggaucggccgcaacccggcccaggaggacgaccaguacguguucagcggggacccccugcggaacgacgaggaccacgcccacuggaccgaggcgaagaugcugcucgacaacaucuacacccccgagggcaucauccccacgcuguucgggccggagcgcgagaagacccaggccaucgacggcgaguuccggcugcgcggcgagcagcggaagaccuucguggagcucaugcgccgcggggaccugcccgucuggcuguccuacaagguggccagcgccggcaucuccuacaaggaccgcgaguggugcuucaccggggagcggaacaaccagauccucgaggagaacauggagguggagaucuggacgcgcgagggcgagaagaagaagcugcggcccaaguggcuggacgcccgcgucuacgcggaccccguggcccucaaggacuucaaggaguucgccagcgggcggaaguccaucacccuggacauccugaccgagaucgccagccucccgaccuaccuguccagccgcgccaagcuggcgcucgacaacaucgugaugcugcacaccacggagcggggcggcaaggccuaccagcacgcccugaacgagcuccccgagagccuggagacccugaugcucaucgcccugcugggggcgaugaccgccggcaucuuccucuucuucaugcaggggaagggcauggggaagcuguccaugggccugaucgccaucgccgucgccagcggccuccuguggguggcggagauccagccccaguggaucgccgccuccaucauccuggaguucuuccucauggcccugcugaucccggagcccgagaagcagcgcacgccccaggacaaccagcucaucuacgugauccugacgauccugaccaucaucgggcucgucgccgcgaacgagaugggccugaucgagaagaccaagaccgacuucggguucuaccaggagaagacggagaccaccauccuggacguggaccuccgccccgccagcgccuggacccuguacgccguggccacgaccauccugaccccgaugcuccggcacaccaucgagaacacguccgcgaaccugagccuggccgccaucgccaaccaggccgcgguccucaugggccuggggaagggcuggccccugcaccgcauggaccucggcgugccccugcuggccauggggugcuacucccaggugaaccccaccacccucaccgccagccuggucaugcugcucgugcacuacgccaucaucggcccggggcugcaggcgaaggccacgcgggaggcccagaagcgcaccgccgccggcaucaugaagaaccccaccguggacggcaucaccgucaucgaccuggagcccaucuccuacgaccccaaguucgagaagcagcucggccaggugaugcugcuggugcucugcgcgggccagcugcugcucaugcggacgaccugggccuucugcgagguccugacccuggccaccgggccgauccucacgcugugggagggcaaccccgggcgcuucuggaacaccaccaucgccgugagcaccgccaacaucuuccggggcuccuaccuggcgggcgccgggcucgccuucagccugaucaagaacacgcagacgccccggcggggcaccgggaccacgggcgagacccugggggagaaguggaagcgccagcucaacucccuggaccggaaggaguucgaggaguacaagcgcagcggcauccuggagguggaccggaccgaggccaaguccgcccucaaggacggcagcaagaucaaguacgcggucucccgcgggaccagcaagauccgguggaucguggagcgcggcauggugaagcccaaggggaaggucguggaccugggcugcgggcggggcggcugguccuacuacauggccacccugaagaacgugacggaggucaagggguacaccaagggcgggccgggccacgaggagcccauccccauggccaccuacggguggaaccucgugaagcugcacagcggcguggacgucuucuacaagcccaccgagcaggucgacacgcugcucugcgacaucggcgagagcuccagcaacccgaccaucgaggaggggcgcacccugcgggugcugaagauggucgagcccuggcucuccagcaagcccgaguucugcaucaaggugcugaaccccuacaugccgaccgugaucgaggagcuggagaagcugcagcgcaagcacggcgggucccucguccgcugcccccugagccggaacuccacgcacgagauguacugggugagcggcgucucccgcaacaucgugagcuccgugaacaccaccagcaagaugcugcucaaccgguucaccacgcgcuaccggaagcccaccuacgagaaggacgccgaccugggcgcggggacccgcuccgucagcaccgagacggagaagcccgacauggccaucaucggccggcgccugcagcggcuccaggaggagcacaaggagaccuggcacuacgaccaggagaacccguaccgcaccugggccuaccacggguccuacgaggcccccagcaccggcuccgccagcuccauggugaacgggguggucaagcugcugacgaagcccugggacguggugccgauggucacccagcucgcgaugaccgacaccacgcccuucggccagcagcggguguucaaggagaagguggacacccgcacgccccagcccaagccgggcacccggaugaucaugacgaccaccgccaacuggcugugggcccugcucgggaagaagaagaacccccgccugugcacccgggaggaguucaucagcaagguccgcagcaacgccgccaucggcgcggugucccaggaggagcagggguggacgagcgccuccgaggccgugaacgacagccgguucugggagcuggucgacaaggagcgcgcccuccaccaggagggcaagugcgaguccugcguguacaacaugauggggaagcgggagaagaagcugggcgaguucggccgcgccaaggggagccgggcgaucugguacauguggcugggcgcccgcuuccucgaguucgaggcccugggguuccugaacgaggaccacugguucggccgcgagaacuccuggagcgggguggagggcgagggccuccaccggcugggguacauccuggaggacaucgacaagaaggacggcgaccucaucuacgccgacgacaccgcggggugggacacccgcaucaccgaggacgaccugcugaacgaggagcucaucacggagcagauggcgccccaccacaagauccuggccaaggccaucuucaagcugaccuaccagaacaaggucgugaaggugcuccggcccaccccgaagggcgccgucauggacaucaucucccgcaaggaccagcggggcagcggccaggugggcaccuacgggcugaacaccuucacgaacauggaggugcagcugauccgccagauggaggcggagggcgucaucacccgggacgacaugcacaaccccaaggggcucaaggagcgcguggagaaguggcugaaggagugcggcguggaccggcugaagcgcauggccaucuccggcgacgacugcgucgugaagccccucgacgagcgguucagcaccucccugcuguuccucaacgacauggggaaggugcgcaaggacaucccccagugggagccgagcaagggcuggaagaacuggcaggagguccccuucugcucccaccacuuccacaagaucuucaugaaggacgggcggagccugguggugcccugccgcaaccaggacgagcugaucggccgggcccgcaucucccagggggccggcuggagccuccgggagaccgccugccugggcaaggcguacgcccagauguggagccugauguacuuccaccgccgggaccuccgccuggccuccauggccaucugcagcgccguccccacggagugguucccgaccucccgcaccaccuggagcauccacgcgcaccaccaguggaugacgaccgaggacaugcugaagguguggaaccggguguggaucgaggacaaccccaacaugaccgacaagacccccguccacuccugggaggacauccccuaccucgggaagcgcgaggaccuguggugcggcagccugaucgggcucuccagccgggccacgugggccaagaacauccacaccgccaucacccaggugcgcaaccugaucggcaucgaggaguacguggacuacaugccggucaugaagcgguacuccgcccccuucgagagcgagggggugcuguga

SEQ ID NO: 10431 - RNA, 9867 nt, Artificial Sequence
  derived and/or modified CDS sequence (opt1) from DENV-4__JQ922558__SS-prME
agcacccugacccuccugugccugauccccacggugauggccuuccaccucuccacccgcgacggcgagccgcugaugaucguggccaagcacgagcgggggcgcccccugcuguucaagaccaccgagggcaucaacaagugcacgcugaucgcgauggaccugggggagaugugcgaggacaccgugaccuacaagugcccccuccuggugaacaccgagcccgaggacaucgacugcuggugcaaccugacgagcaccugggugauguacgggaccugcacccaguccggggagcggcgccgggagaagcgcagcguggcccucacgccgcacuccggcaugggccuggagacccgggccgagaccuggaugagcuccgagggggccuggaagcacgcccagcgcguggagagcuggauccugcggaaccccggcuucgcgcuccuggccggguucauggccuacaugaucggccagaccgggauccagcgcacgguguucuucgugcugaugaugcucguggcccccuccuacggcaugcggugcgugggcguggggaaccgcgacuucguggagggcgugagcgggggcgcguggguggaccuggugcuggagcacggcgggugcgucaccaccauggcccagggcaagcccacccucgacuucgagcugaucaagacgaccgccaaggagguggcccugcuccggaccuacugcaucgaggccuccaucagcaacaucaccacggcgacccgcugccccacccagggggagcccuaccugaaggaggagcaggaccagcaguacaucugccggcgcgacguggucgaccggggcugggggaacggcugcggccuguucgggaagggcgggguggugaccugcgccaaguuccucugccugggcaagaucacggggaaccugguccagaucgagaaccucgaguacaccgugguggucaccgugcacaacggcgacacccacgccgucggcaacgacaucuccaaccacggggugacggccaccaucacgccccggagccccuccguggaggucaagcugccggacuacggcgagcugacccucgacugcgagccccggagcgggaucgacuucaacgagaugauccugaugaagaugaagaagaagacguggcuggugcacaagcagugggugcucgaccugccccugcccugggccgcgggcgccgacaccuccaagguccaguggaacuacaaggagcgcauggugaccuucaaggugccgcacgccaagcggcaggacgucaccgugcucgggagccaggagggcgccaugcacuccgcccugaccggcgcgacggagguggacagcggggacggcaaccacauguucgccgggcaccugaagugcaagguccgcauggagaagcuccgcaucaagggcaugagcuacaccaugugcuccggcaaguucagcaucgacaaggagauggccgagacccagcacgggaccacgguggugaaggucaaguacgagggcgccggggcccccugcaaggugcccaucgagauccgggacgugaacaaggagaaggucgugggccgcaucaucuccagcacccccuucgcggagcacaccaacuccgugaccaacaucgagcuggagccgcccuucggggacagcuacaucgucaucggcgugggcgacuccgcccugacgcuccacugguuccggaaggggagcuccaucggcaagauguucgagagcaccuaccgcggggccaagcggauggccauccugggcgagaccgcgugggacuucggguccgugggcggccuguucaccagccucgggaaggccguccaccagguguucggcuccguguacacgaccauguucgggggcgucagcuggauggugcgcauccugaucgggcugcuggugcucuggaucggcaccaacucccggaacaccagcauggccaugacgugcaucgccaucggcgggaucacccuguuccugggcuucaccguccacgccgacauggggugcgcgguguccuggagcggcaaggagcucaagugcggguccggcaucuucguggucgacaacgugcacaccuggacggagcaguacaaguuccagcccgagagccccgcccgccuggccagcgccauccugaacgcccacaaggacggcgugugcgggauccgguccaccacccgccucgagaacgucauguggaagcagaucaccaacgagcugaacuacgugcugugggagggcgggcacgaccucacgguggucgcgggcgacgugaagggcgugcugaccaaggggaagcgggcccugaccccgcccgucaacgaccucaaguacagcuggaagaccuggggcaaggccaagaucuucacgcccgaggcccgcaacuccaccuuccugaucgacgggcccgacaccagcgagugcccgaacgagcggcgcgccuggaacuuccuggagguggaggacuacggcuucgggauguucaccacgaacaucuggaugaaguuccgggagggcuccagcgaggugugcgaccaccgccucauguccgcggccaucaaggaccagaaggccguccacgccgacaugggcuacuggaucgagagcuccaagaaccagcccuggcagaucgggaacgcgagccugaucgaggugaagaccugccuguggcccaagacccacacccucugguccaacggcgugcuggagagccagaugcugaucccgaaggccuacgccgggcccuucucccagcacaacuaccggcagggcuacgccacgcagaccaucgggcccuggcaccucggcaagcuggagaucgacuucggcgagugccccgggaccaccgucaccauccaggaggacugcaaccaccgcggcccgagccugcggacgaccaccgccuccgggaagcucgugacccaguggugcugccgcagcugcacgaugccgccccugcgcuuccugggcgaggacgggugcugguacggcauggagauccggccccucuccgagaaggaggagaacauggucaagagccaggucagcgcgggccaggggaccuccgagaccuucagcaugggccugcugugccucacccuguucguggaggagugccugcgccggcgcgucacgcggaagcacaugauccucgugguggucaccacccugugcgccaucauccucggcggccucaccuggauggaccugcugcgcgcccucaucaugcugggcgacacgauguccgggcggaugggcgggcagauccaccugaccaucauggccguguucaagaugagcccgggcuacgugcucggggucuuccugcgcaagcugaccucccgggagaccgcccucaucgugaucggcauggcgaugacgaccgugcugagcaucccccacgaccugauggaguucaucgacggcaucucccucgggcugauccugcucaagauggucgcccacuucgacaacacccaggugggcacccuggcccugagccucacguucauccgcuccaccaugccccuggugauggccuggcggaccaucauggccguccuguucguggugacccucaucccccugugccgcacgagcugccugcagaagcagucccacugggucgagaucaccgcgcucauccugggggcccaggcccugccgguguaccucaugacccugaugaagggcgccagcaagcgguccuggccccugaacgaggggaucauggcggugggccucgucagccugcugggcuccgcccuccugaagaacgacgugccccuggccgggcccaugguggccggcgggcuccugcuggccgcguacgucaugagcggcuccagcgccgaccucucccuggagaaggccgccaacgugcacugggacgagauggccgacaucaccgggagcagcccgaucaucgaggugaagcaggacgaggacggcuccuucagcauccgcgacgucgaggagacgaacaugaucacccugcucgugaagcuggcgcugaucaccguguccggccucuacccccuggccauccccgucaccaugacgcugugguacauguggcaggucaagacccagcggagcggggcccucugggacgugcccuccccggccgccgcgcagaaggccacccugaccgagggcgucuaccgcaucaugcagcgggggcuguucggcaagacccaggugggggugggcauccacauggagggcgucuuccacaccauguggcacgugacccgcgggagcgugaucugccacgagaccggccggcucgagcccuccugggccgacguccgcaacgacaugaucagcuacgggggcggcuggcggcugggggacaagugggacaaggaggaggacguccaggugcuggccaucgagcccggcaagaaccccaagcacguccagaccaagccggggcuguucaagacgcugaccggcgagaucggggccgugacccuggacuucaagcccggcaccuccggcagccccaucaucaacaagaaggggaaggugaucggccucuacgggaacggcgucgugacgaaguccggggacuacgugagcgcgaucacccaggccgagcgcaucggcgacccggacuacgaggucgacgaggacaucuuccgcaagaagcggcugaccaucauggaccugcaccccggcgccgggaagaccaagcgcauccugcccuccaucgugcgggaggcccucaagcgccggcugcgcacgcugauccucgcgcccacccggguggucgccgccgagauggaggaggcccugcgcggccugccgauccgguaccagacccccgccgucaagagcgagcacaccgggcgcgagaucguggaccucaugugccacgcgacguucaccgccaacccccuguccagcacccggguccccaacuacaaccugaucgugauggacgaggcccaccuccaggaccuguccaucgucgccgcccgcggcuacaucagcacccggguggagaugggggaggcggccgccaucuucaugacggccaccccgcccggcgccaccgaccccuucccccaguccaacagcccgaucgaggacaucgagcgcgagauccccgagcggagcuggaacaccggcuucgacuggaucacggacuaccaggggaagaccgugugguucguccccuccaucaaggcgggcaacgacaucgccaacugccugcgcaagagcgggaagaaggugauccagcucucccggaagaccuucgacaccgaguaccccaagacgaagcugaccgacugggacuucguggucaccaccgacaucagcgagaugggcgccaacuuccgcgcccggcgcgugaucgacccgcgccggugccugaagcccgugauccucacggacgggcccgagcgcgucauccuggcgggccccaucccggugacccccgccuccgccgcccagcggcgcggccggaucgggcgcaaccccgcccaggaggacgaccaguacguguucagcggcgacccccugaagaacgacgaggaccacgcgcacuggaccgaggccaagaugcuccuggacaacaucuacaccccggaggggaucauccccacgcuguucggccccgagcgggagaagauccaggccaucgacggcgaguuccgccuccgcggggagcagcgcaagaccuucgucgagcugaugcggcgcggcgaccugcccguguggcucuccuacaagguggccagcgccgggaucuccuacaaggaccgggaguggugcuucaccggcgagcgcaacaaccagauccuggaggagaacauggaggucgagaucuggacccgggagggggagaagaagaagcugcgcccgaaguggcucgacgcgcggguguacgccgaccccauggcccugaaggacuucaaggaguucgccagcggccgcaaguccaucacgcuggacauccucaccgagaucgccagccugcccaccuaccuguccagccgggcgaagcucgcccuggacaacaucgugaugcugcacaccacggagcgcggcgggcgggccuaccagcacgcccucaacgagcugccggagucccuggagacccucaugcuggucgcgcugcucggcgccaugaccgccgggaucuuccuguucuucaugcagggcaaggggaucggcaagcugagcaugggccucauggccaucgccguggcguccgggcugcuguggguggccgagauccagccccaguggaucgccgccagcaucauccucgaguucuucuccauggcccugcugauccccgagcccgagaagcagcgcaccccgcaggacaaccagcucaucuacgucauccugaccauccugacgaucaucggccucaucgcggccaacgagauggggcugaucgagaagaccaagaccgacuucggcuucuaccaggugaagaccgagacgaccauccuggacguggaccuccgccccgccagcgccuggacccuguacgccgucgcgaccacgauccugacccccaugcuccggcacaccaucgagaacaccagcgccaaccugucccuggccgccaucgccaaccaggcggccgugcucauggggcugggcaagggcuggccccugcaccgcauggaccucggggugccgcugcuggccaugggcugcuacagccaggucaaccccacgacccucaccgccucccuggugaugcugagcgugcacuacgcgaucaucgggcccggccuccaggccaaggccacccgggaggcccagaagcgcuccgccgcgggcaucaugaagaaccccacggucgacgggaucaccgugaucgaccuggagccgaucagcuacgaccccaaguucgagaagcagcugggccaggugaugcuccuggcccugugcgccgggcagcuccugcugaugcggaccaccugggccuucugcgagguccucacgcuggccaccggccccauccugacccucugggaggggaaccccggccgcuucuggaacaccacgaucccgguguccaccgcgaacaucuuccggggcagcuaccuggccggggccggccuggccuucucccucaucaagaacgcccagacgccccgccgggggaccggcacgaccggggagacccugggcgagaaguggaagcgccagcugaacagccucgaccggaaggaguucgaggaguacaagcgcuccggcaucuucgagguggaccggcacgagaucaaguacacccugaaggacgggagcaagaucaaccacgcgauguccacgggcagcaucaagauccgcgggaucgacgagcggggcauggucaagcccaaggggaaggugguggaccagggcugcggccgcgggggcuggucccacuacaccgccaccgccaagaaggucaccgaggugaagggguacacgaagggcgggcccggccacgaggagccgauccccauggccaccuacggcuggaaccuggugaagcuccacagcggggucgacguguucuacaagcccaccgagcaggucgacacccugcugugcgacaucggcgaguccagcuccaaccccaccaucgaggaggggcggacgcuccgcguccugaagaugguggagccguggcugagcagcaagcccgaguucugcaucaaggugcucaaccccuacaugcccaccgucaucgaggagcuggagaagcugcagcggaagcacggcggcucccuggugcgcugcccgcucagccgcaacuccacccacgagauguacugggugagcggggucuccggcaacaucgugagcuccgucaacaccacgagcaagaugcugcugaaccgguucaccacccgccaccggaagcccaccuacgagaaggacguggaccucggggcgggcacgcgcuccgugagcaucgagaccgagaagcccgacaugaccaucaucgggcggcgccugcagcggcugcgcgaggagcacaaggagaccuggcacuacgaccaggagaacccguaccggacgugggccuaccacggcuccuacgaggcccccagcaccggcuccgccagcuccauggucaacgggguggugaagcuccugaccaagcccugggacgucauccccauggugacccagcuggccaugacggacaccaccccguucggccagcagcgcgaguucaaggagaagguguacaccagcacgccccaccccaagcccuggacccggauggucaugaccaccacggcgaacuggcucugggcccucgggggcaagaagaaguccccgcgccugugcaccugggaggaguucaucagcaaggugcgguccaacgccgccaucggggccguguuccaggaggagcagggcuggaccagcgcgagcgaggccgucaacgacucccgcuucugggagcucguggacaaggagcgggcccugcaccaggagggcaagugcgagagcugcguguacaacaugauggggaagcgcgagaagaagcugggcgaguucgggcgggccaagggcucccgcgccaucugguacauguggcucggggcgcgguuccuggaguucgaggcccugggcuuccucaacgaggaccacugguucggccgcgagaacagcugguccggggucgagggcgaggggcugcaccggcugggcuacauccucgaggacaucgacaagaaggacggcgaccugaucuacgccgacgacaccgccgggugggacacgcgcaucaccgaggacgaccugcucaacgaggagcugaucaccgagcagauggcgccccaccaccgcauccuggccaaggccaucuucaagcucaccuaccacagcaaggugaugaaggugcugcggcccacgcccaagggcgccgucauggacaucaucucccgcaaggaccagcgggggagcggccagguggggaccuacggccugaacaccuucaccaacauggaggugcagcucauccgccagauggaggccgagggcgucaucacgcaggacgacaugcagaacccgaaggggcugaaggagcggguggagaaguggcugaaggagugcggcguggaccgccucaagcggauggcgaucuccggggacgacugcgucgugaagccccuggacgagcgcuucagcaccucccuccuguuccugaacgacaugggcaaggugcggaaggacaucccccagugggagcccagcaagggguggaagaacuggcaggaggucccguucugcucccaccacuuccacaagaucuucaugaaggacggccgcagccugguggugcccugccggaaccaggacgagcucaucggccgcgcccggaucucccagggggccggcuggagccugcgcgagaccgccugccuggggaaggccuacgcgcagauguggucccucauguacuuccaccggcgcgaccugcggcuggccagcauggccaucugcagcgccguccccaccgagugguuccccaccucccgcacgaccuggagcauccacgcccaccaccaguggaugaccaccgaggacaugcucaagguguggaaccggguguggaucgaggacaacccgaacaugacggacaagacccccguccacuccugggaggacgugcccuaccugggcaagcgcgaggaccuguggugcgggagccucaucggccuguccagccgcgcgaccugggccaagaacauccacaccgccaucacccaggugcggaaccugaucggcaaggaggaguacgucgacuacaugcccgugaugaagcgcuacuccgccccgaucgagagcgagggggugcucuga

SEQ ID NO: 10432 - RNA, 9867 nt, Artificial Sequence
  derived and/or modified CDS sequence (opt1) from DENV-4__JQ922559__SS-prME
agcaccaucacccugcucugccugauccccaccgugauggccuuccaccuguccacccgcgacggcgagccgcucaugaucguggccaagcacgagcgggggcgcccccugcuguucaagaccaccgagggcaucaacaagugcacccucaucgccauggaccugggggagaugugcgaggacaccgugaccuacaagugcccccugcucgugaacaccgagcccgaggacaucgacugcuggugcaaccugaccagcgccugggugauguacgggaccugcacccaguccggggagcggcgccgggagaagcgcagcguggcccugaccccgcacuccggcaugggccucgagacccgggccgagaccuggaugagcuccgagggggccuggaagcacgcgcagcgcguggagagcuggauccugcggaaccccggcuucgcccugcucgccggguucauggccuacaugaucggccagaccgggauccagcgcaccguguucuucauccugaugaugcugguggcgcccuccuacggcaugcggugcgugggcgucgggaaccgcgacuucguggagggcgugagcgggggcgccugggucgaccucgugcuggagcacggcgggugcgugacgaccauggcccagggcaagcccacccuggacuucgagcucaucaagaccacggccaaggaggucgcccugcugcggaccuacugcaucgaggcguccaucagcaacaucaccaccgccacgcgcugcccgacccagggggagcccuaccucaaggaggagcaggaccagcaguacaucugccggcgcgacgugguggaccggggcugggggaacggcugcggccuguucgggaagggcggggucgugaccugcgccaaguuccugugcuccggcaagaucaccgggaaccucgugcagaucgagaaccuggaguacacggucguggugaccguccacaacggcgacacccacgccgugggcaacgacaucagcauccacggggucaccgccacgaucacgccccgcucccccagcguggaggugaagcugccggacuacggcgagcucacccuggacugcgagccccgguccgggaucgacuucaacgagaugauccugaugaagaugaagaagaagaccuggcucguccacaagcagugguuccuggaccugccccuccccuggacggcgggcgccgacaccagcgaggugcaguggaacuacaaggagcgcauggugaccuucaaggucccgcacgccaagcggcaggacgugaccgugcuggggucccaggagggcgccaugcacagcgcccugaccggcgcgacggaggucgacagcggggacggcaaccacauguucgccgggcaccucaagugcaaggugcgcauggagaagcugcgcaucaagggcauguccuacaccaugugcagcggcaaguucuccaucgacaaggagauggccgagacccagcacgggaccacgguggucaaggugaaguacgagggcgccggggcccccugcaaggugcccaucgagauccgggacgucaacaaggagaagguggugggccgcaucaucagcuccacccccuucgcggagaacaccuacagcgucaccaacaucgagcuggagccgcccuucggggacuccuacaucaucaucggcgugggcgacagcgcccucacgcugcacugguuccggaagggguccagcaucggcaagauguucgaguccaccuaccgcggggccaagcggauggccauccugggcgagaccgcgugggacuucgggagcgugggcggccuccugaccucccuggggaaggccguccaccagguguucggcagcguguacacgaccauguucgggggcgucuccuggauggugcgcauccucaucgggcugcuggugcuguggaucggcaccaacagccggaacaccuccauggccaugagcugcaucgccgucggcgggaucacccucuuccugggcuucaccgugcacgccgacauggggugcgcgguguccuggagcggcaaggagcugaagugcgggagcggcaucuucgucaucgacaacgugcacaccuggaccgagcaguacaaguuccagcccgagucccccgcccgccucgccagcgccauccugaacgcccacaaggacggcgugugcgggauccgguccacgacccgccuggagaacgucauguggaagcagaucaccaacgagcucaacuacgugcugugggagggcgggcacgaccugaccaucguggcgggcgacgucaagggcgugcucagcaaggggaagcgggcccuggccccgcccgugaacgaccugaaguacuccuggaagacguggggcaaggccaagaucuucacccccgagacccgcaacagcaccuuccucaucgacgggcccgacacguccgagugcccgaacgagcggcgcgccuggaacuuccuggaggucgaggacuacggcuucgggauguucaccaccaacaucuggaugaaguuccgggagggcagcuccgaggugugcgaccaccgccugaugagcgcggccaucaaggaccagaaggccgugcacgccgacaugggcuacuggaucgaguccagcaagaaccagaccuggcagaucgagaaggcgucccucaucgaggucaagacgugccuguggcccaagacccacacccuguggagcaacggggugcucgagucccagaugcugauccccaaggccuacgccggcccguucagccagcacaacuaccggcagggguacgccacccagacggugggccccuggcaccuggggaagcucgagaucgacuucggcgagugccccggcaccaccgucaccauccaggaggacugcgaccaccgcgggcccucccugcggaccacgaccgccagcggcaagcuggugacccaguggugcugccgcagcugcaccaugccgccccuccgcuuccugggggaggacggcugcugguacgggauggagauccggccccuguccgagcgcgaggagaacauggucaagagccaggucuccgcgggccagggcacgagcgagaccuucuccauggggcuccugugccugacccucuucguggaggagugccugcggcgccgggugacccgcaagcacaugauccuggucguggucacgacccucugcgccaucauccugggcgggcugaccuggauggaccuccugcgggcccugaucaugcucggcgacaccaugagcucccgcaugggcgggcagauccaccuggccaucauggccguguucaagaugagccccggcuacgugcuggggaucuuccuccggaagcugacgucccgcgagaccgcgcugauggucaucggcauggccaugaccaccgugcucagcaucccgcacgaccugauggaguucaucgacgggaucucccugggccucauccugcugaagauggugacgcacuucgacaacacccagaugggcacccucgcccugagccugaccuucaucaaguccacgaugccccucgucauggccuggcggaccaucauggccgugcuguucguggucacccugaucccccucugccgcaccagcugccugcagaagcagucccacuggguggagaucacggcgcugauccucggggcccaggcccugcccguguaccugaugacccucaugaagggcgccagcaagcgguccuggccgcugaacgaggggaucauggcggucggccuggugagccuccugggguccgcccugcucaagaacgacgugccccuggccggccccauggucgccggcgggcugcuccuggccgcguacgugaugagcggcagcuccgccgaccugagccucgagaaggccgccaacgugcagugggacgagauggccgacaucaccggguccagccccaucaucgaggucaagcaggacgaggacggcuccuucagcauccgcgacguggaggagaccaacaugaucacgcugcuggugaagcucgcgcugaucaccgucuccgggcuguacccgcucgccauccccgugaccaugacccugugguacauguggcaggucaagacgcagcggagcggcgcccugugggacguccccucccccgccgccgcgcagaaggccacccucaccgagggcguguaccgcaucaugcagcgggggcuguucggcaagacccaggugggggucggcauccacauggaggggguguuccacacgauguggcacgugacccgcggcagcgucaucugccacgaguccggccggcuggagccgagcugggccgacgugcgcaacgacaugaucuccuacgggggcggguggcggcucggcgacaagugggacaaggaggaggacgugcagguccuggccaucgagcccggcaagaaccccaagcacgugcagaccaagcccgggcuguucaagacccucaccggcgagaucggggccgugacgcuggacuucaagccgggcaccagcgggucccccaucaucaaccgcaagggcaaggucaucggccuguacgggaacggcguggugaccaagagcggggacuacgucuccgcgaucacccaggccgagcgcaucggcgagcccgacuacgagguggacgaggacaucuuccggaagaagcgccucacgaucauggaccugcacccgggggccggcaagaccaagcggauccugcccagcaucgugcgcgaggcccugaagcggcgccuccggacccugauccuggcgcccacccgcgucguggccgccgagauggaggaggcccuccggggccugcccauccgcuaccagacgccggccgugcuguccgagcacaccgggcgggagaucgucgaccucaugugccacgcgaccuucaccacgcgccugcugagcagcacccgggugcccaacuacaaccucaucgugauggacgaggcccacuucaccgaccccuccagcgucgccgcccgcggcuacaucuccacccggguggagaugggggaggccgcggccaucuucaugacggccacgccgcccggcaccaccgaccccuucccccagagcaacucccccaucgaggacaucgagcgcgagauccccgagcggagcuggaacacgggguucgacuggaucaccgacuaccagggcaagaccgugugguucguccccuccaucaaggccggcaacgacaucgccaacugccugcgcaagagcgggaagaaggugauccagcugucccggaagaccuucgacacggaguaccccaagaccaagcucaccgacugggacuucgucgugaccacggacaucagcgugaugggcgcgaacuuccgcgccgggcgcgucaucgacccccggcgcugccugaagccggugaucaucaccgacggccccgagcgggugauccuggccgggcccauccccgucaccccggccuccgcggcccagcgccggggccgcaucggccggaaccccgcccaggaggacgaccaguacguguucagcggggacccccuccgcaacgacgaggaccacgcccacuggaccgaggccaagaugcugcuggacaacaucuacacgcccgagggcaucaucccgacccucuucgggcccgagcgggagaagacccaggcgaucgacggcgaguuccgccugcggggcgagcagcgcaagaccuucguggagcugaugcggcgcggggaccuccccgucuggcuguccuacaagguggccagcgccggcaucuccuacaaggaccgggaguggugcuucacgggggagcgcaacaaccagauccuggaggagaacauggagguggagaucuggacccgggagggcgagaagaagaagcuccgccccaaguggcuggacgcccgggucuacgccgacccgauggcgcugaaggacuucaaggaguucgccagcgggcgcaaguccaucacccucgacauccugaccgagaucgccagccugcccacguaccucuccagccgggccaagcuggcccuggacaacaucgugaugcuccacaccaccgagcgcggcggcaaggcguaccagcacgcccugaacgagcugcccgagagccucgagacccugaugcugguggcccuccugggggccaugaccgcgggcaucuuccuguucuucaugcaggggaagggcaucggggagcucuccaugggccugaucgccaucgccggcgccagcgggcugcucuggggcacgaagaccccgccgcccuggggcgccgcguccaacauccuggaguucuuccugaugguccuccugauccccgagccggagaagcagcgcacgccccaggacaaccagcugaucuacgugauccucaccauccugacgaucaucggccugguggccgccaacgagauggggcucaucgagaagaccaagaccgacuucggcuucuaccaggucaagaccgagacgaccauccuggacguggaccugcggcccgccagcgccuggacccucuacgcgguggccaccacgauccugacccccaugcugcgccacaccaucgagaacaccuccgccaaccucagccuggccgccaucgcgaaccaggccgccguccugaugggccucgggaagggcuggccgcugcaccggauggaccugggggugccccuccuggccaugggcugcuacucccaggugaaccccacgacccugaucgccagccucgucaugcugcuggugcacuacgcgaucaucggccccgggcuccaggccaaggccacccgcgaggcccagaagcggaccgcggccggcaucaugaagaacccgacgguggacgggaucaccgucaucgaccuggagcccaucuccuacgaccccaaguucgagaagcagcugggccaggugaugcuccuggugcugugcgccgggcagcuccugcugaugcgcaccaccugggccuucugcgagguccucacgcuggccaccggccccauccugacccucugggagggcaacccggggcgguucuggaacaccacgaucgcggugagcaccgccaacaucuuccgcggcuccuaccuggccggggccggccuggccuucagccucaucaagaacgcgcagacgccccggcgcgggaccggcgugacgggcgagacccugggggagaaguggaagcggcagcugaacucccucgaccgcaaggaguucgaggaguacaagcggagcggcauccuggaggucgaccgcaccgaggccaaguccgcccugaaggacgggagcaagaucaagcaggccgugucccggggcaccagcaagauccgcuggaucguggagcgggggauggucaagcccaagggcaaggugguggaccucggcugcgggcgcggcgggugguccuacuacauggccacgcugaagaacgucaccgaggugaagggcuacaccaagggcgggcccggccacgaggagccgauccccauggcgaccuacggguggaaccuggugaagcuccacagccgggucgacguguucuacaagcccaccgagcaggucgacacgcugcugugcgacaucggcgagagcuccagcaaccccaccaucgaggaggggcgcacccuccgcguccugaagaugguggagccguggcuguccagcaagcccgaguucugcaucaaggugcugaaccccuacaugcccaccgucaucgaggagcucgagaagcugcagcggaagcacggcggcucccuggugcgcugcccgcucagccggaacuccacgcacgagauguacugggugagcggggucuccggcaacaucgugagcuccgucaacaccaccagcaagaugcugcugaaccgcuucaccacgaagcaccggaagcccaccuacgagaaggacgccgaccucggggccggcacccgcuccgugagcaccgagacggagaagcccgacaugaccaucaucgggcggcgccugcagcggcugcaggaggagcaccaggagaccuggcacuacgaccaggagaacccguaccgcaccugggccuaccacggcggcuacgaggcgcccuccacggggagcgccuccagcauggugaacggcgucgugaagcuccugaccaagcccugggacgugauccccauggucacccagcuggccaugaccgacacgaccccguucgggcagcagcggguguucaaggagaagguggacacccgcacgccccagcccaagcccggcacgcggauggucaugaccaccaccgccaacuggcucugggcccugcuggggaagaagaagaacccgcgccucugcacgcgggaggaguucaucuccaaggugcgcagcaacgcggccaucggcgccgugagccaggaggagcagggcuggaccuccagcuucgaggccgucaacgacucccgguucugggagcugguggacaaggagcgcgcccugcaccaggaggggaagugcgagagcugcguguacaacaugaugggcaagcgggagaagaagcucggggaguucggccgcgcgaaggggucccgggccaucugguacauguggcugggcgcccgcuuccuggaguucgaggcccucggcuuccugaacgaggaccacugguucgggcgcgagaacagcugguccggcgucgagggggagggccugcaccggcucggcuacauccuggaggaccuggacaagcgcgaccggagccucguguucgccgacgacaccgcggggugggacaccaagauccccgaggacgaccugcugaaggagaagcccauccccggcccgauggcgccccaccagcgcauccccgcccgggccaucuucaagcucacguaccagaacaagguggucaaggugcugcgccugaagcucaagggggcggugauggacaucaucucccggaaggagcagcgcggcagcgggcaggucggcaccuacggccugaacaccuucaccaacauggaggugcagcugauccggcagauggaggccgagggggugaucacgcgcgacgacaugcacaaccccaagggccucaaggagcgggucgagaaguggcugaaggagugcgggguggaccgccuggagcggauggccaucuccggcgacgacugcguggucaagccgcucgacgagcgcuucagcaccucccugcuguuccucaacgacauggggaaggugcggaaggacaucccccagugggagcccagcaagggcuggaagaacuggcaggaggugcccuucugcucccaccacuuccacaagaucuucaugaaggacggccgcagccuggucgugccgugccggaaccaggacgagcugaucgggcgcgcccggaucucccagggcgccggguggagccuccgcgagaccgcgugccugggcaaggccuacgcccagauguggagccugauguacuuccaccgccgggaccuccgccuggccuccauggccaucugcagcgcggugcccaccgagugguuccccaccucccggacgaccuggagcauccacgcccaccaccaguggaugaccaccgaggacaugcugaaggucuggaaccgcguguggaucgaggacaaccccaacaugacggacaagaccccggugcacuccugggaggacauccccuaccucgggaagcgggaggaccuguggugcggcagccugaucggccucuccagccgcgccaccugggccaagaacauccacaccgccaucacgcagguccggaaccugaucgggaucgagggcuacguggacuacuuccugcucaucaagugguacuccgcgcccuucgagagcgagggggugcuguga

SEQ ID NO: 10433 - RNA, 9867 nt, Artificial Sequence
  derived and/or modified CDS sequence (opt1) from DENV-4__KF955510__SS-prME
agcaccaucacccugcucugccugauccccacggugauggccuuccaccuguccacccgcgacggcgagccgcucaugaucgucgccaagcacgagcgggggcgcccccugcuguucaagaccaccgagggcaucaacaagugcacgcucaucgcgauggaccugggggagaugugcgaggacaccgugaccuacaagugcccccugcucgugaacaccgagcccgaggacaucgacugcuggugcaaccugacgagcgccugggucauguacggcaccugcacccaguccggggagcggcgccgggagaagcgcagcguggcccugaccccgcacuccggcaugggccucgagacgcggaccgagaccuggaugagcuccgagggggccuggaagcacgcccagcgcguggagagcuggauccugcggaagcccggcuucgcgcuguccgccggguucauggccuacaugaucggccagaccgggauccagcgcacggucuucuucauccucaugaugcugguggcccccagcuacggcaugcggugcgugggcgucgggaaccgcgacuucguggagggcguguccgggggcgcgugggucgaccuggugcucgagcacggcgggugcgugaccaccauggcccagggcaagcccacccuggacuucgagcugaucaagacgaccgccaaggaggucgcccuccugcggaccuacugcaucgaggccagcaucuccaacaucaccacggcgacccgcugcccgacccagggggagcccuaccugaaggaggagcaggaccagcaguacaucugccggcgcgacaugguggaccggggcugggggaacggcugcggccucuucgggaagggcgggguggucaccugcgccaaguucagcugcuccggcaagaucacggggaaccuggugcagaucgagaaccuggaguacaccguggucgugaccgugcacaacggcgacacccacgccgucggcaacgacacgagcaaccacggggagaccgccaccaucaccccccgcucccccagcguggagguccggcucccggacuacggcgagcugacgcuggacugcgagccccgcuccgggaucgacuucaacgagaugauccucaugaagaugaagaccaagaccuggcuggugcacaagcagugguuccuggaccucccccugcccuggaccgccggcgcggacaccagcgaggugcacuggaaccacaaggagcggauggucacguucaaggugccgcacgccaagcgccaggacgugaccguccuggggagccaggagggcgccaugcacuccgcccucgccggcgcgaccgagguggacagcggggacggcaaccacauguucgccgggcaccugaagugcaaggugcgcauggagaagcugcggaucaagggcauguccuacaccaugugcagcggcaaguucuccaucgacaaggagauggccgagacgcagcacgggaccaccgucgugaaggugaaguacgagggcaccggggcccccugcaagguccccaucgagauccgcgacgugaacaaggagaagguggucggccggaucaucagcuccacgcccuucgccgagaacaccaacagcgugaccaacaucgagcucgagccgcccuucggggacuccuacaucgugaucggcgcgggcgacagcgcccugacccugcacugguuccgcaagggguccagcaucggcaagauguucgaguccacguaccggggggccaagcgcauggccauccucggcgagaccgcgugggacuucgggagcgucggcggccugcugaccucccucgggaaggccgugcaccagguguucggcagcgucuacaccacgauguucgggggcguguccuggauggugcggauccugaucgggcugcucguccuguggaucggcaccaacagccgcaacaccuccauggccaugagcugcaucguggugggcgggaucacccuguuccugggcuucacgguccacgccgacauggggugcguggugagcugguccggcaaggagcucaagugcgggagcggcaucuucgucaucgacaacgugcacaccuggaccgagcaguacaaguuccagcccgagucccccgcccggcuggcgagcgccauccugaacgcccacaaggacggcgugugcgggauccgcuccaccacgcggcucgagaacgucauguggaagcagaucaccaacgagcugaacuacgugcugugggagggcgggcacgaccucaccguggucgccggcgacgugaagggcgugcugagcaaggggaagcgcgcccuggcgccgcccgucaacgaccucaaguacuccuggaagaccuggggcaaggccaagaucuucacgcccgagacccggaacagcaccuuccugguggacgggcccgacaccuccgagugcccgaacgagcgccgggccuggaacuuccuggagguggaggacuacggcuucgggauguucacgaccaacaucuggaugaaguuccgcgagggcagcuccgaggucugcgaccaccggcucaugagcgccgccaucaaggaccagaaggcggugcacgccgacaugggcuacuggaucgaguccagcaagaaccagaccuggcagaucgagaaggccucccugaucgaggugaagaccugccuguggcccaagacgcacacccucuggagcaacgggguccuggagucccagaugcugauccccaaggccuacgcgggcccgaucagccagcacaacuaccgccagggguacgccacccagaccgugggccccuggcaccucgggaagcuggagaucgacuucggcgagugccccggcaccacggugaccauccaggaggacugcgaccaccgggggcccagccugcgcaccaccacggccuccggcaagcucgucacccaguggugcugccgcagcugcaccaugccgccccugcgguuccugggggaggacggcugcugguacgggauggagauccgcccccucaacgagaaggaggagaacauggugaagucccaggugagcgccggccagggcaccuccgagacguucagcauggggcugcugugccucacccuguucgucgaggagugccugcggcgccgggugacccgcaagcacaugauccucgucguggugaccacgcugugcgccaucauccugggcgggcucaccuggauggaccugcugcgggcgcucaucaugcugggcgacaccauguccggccgcauggggggccagauccaccuggccaucauggccauguucaagaugagccccggguacguccucggcaucuuccugcggaagcugaccucccgcgagacggcccucauggugaucgggauggccaugaccaccgugcugagcaucccgcacgaccugauggaguucaucgacggcaucucccucggccugauccugcucaagauggucacccacuucgacaacacgcagguggggacccuggcgcugagccucaccuucaucaaguccaccaugccccuggugauggccuggcggacgaucauggccguccuguucguggugacccucaucccccugugccgcaccagcugccugcagaagcagucccacugggucgagaucaccgcccucauccugggcgcccaggcgcugcccguguaccucaugacgcugaugaagggggccagcaagcgguccuggccgcugaacgagggcaucauggccguggggcucgucagccugcugggcuccgcccuccugaagaacgacgugccccuggcgggccccaugguggccgggggccuccugcuggccgccuacgucaugagcgggagcuccgccgaccucagccuggagaaggcggccaacgugcagugggacgagauggccgacaucaccggcuccagccccaucaucgaggugaagcaggacgaggacggguccuucagcauccgcgacgucgaggagaccaacaugaucacccugcucgugaagcuggcccugaucacgguguccggccucuacccgcuggccauccccgucaccaugacccugugguacauguggcaggugaagacccagcggagcggcgcgcucugggacgugcccucccccgccgccgcccagaaggccacgcugaccgagggggcguaccgcaucaugcagcggggccuguucgggaagacccaggucggcguggggauccacauggagggcguguuccacaccauguggcacgucacccgcggcagcgugaucugccacgaguccgggcggcucgagccgagcugggccgacgugcgcaacgacaugaucuccuacggcgggggcuggcggcugggcgacaagugggacaaggaggaggacguccaggugcuggccaucgagcccgggaagaaccccaagcacgugcagacgaagcccggccucuucaagacccugaccggggagaucggcgccgucacccuggacuucaagccggggacgagcggcucccccaucaucaaccgcaagggcaaggugaucgggcucuacggcaacgggguggucaccaagagcggcgacuacguguccgccaucacccaggcggagcgcaucggggagcccgacuacgagguggacgaggacaucuuccggaagaagcgccugaccaucauggaccugcacccgggcgccggcaagacgaagcggauccuccccagcaucguccgcgaggcccugaagcggcgccugcggacccugauccucgcccccacccgcgugguggcggccgagauggaggaggcccugcgggggcugcccauccgcuaccagaccccggccgucaaguccgagcacacgggccgggagaucguggaccucaugugccacgccaccuucaccacccgccugcugagcagcacgcgggugcccaacuacaaccucaucgucauggacgaggcgcacuucaccgaccccuccagcguggccgcccgcggguacaucuccacccggguggagaugggcgaggccgccgcgaucuucaugaccgccacgcccccggggaccaccgaccccuucccccagagcaacucccccaucgaggacaucgagcgcgagaucccggagcggagcuggaacaccggcuucgacuggaucacggacuaccagggcaagaccgucugguucgugcccuccaucaaggccgggaacgacaucgccaacugccugcgcaagagcggcaagaaggucauccagcugucccggaagaccuucgacaccgaguaccccaagacgaagcucaccgacugggacuucguggugaccaccgacaucagcgagaugggggccaacuuccgcgcgggccgcgucaucgacccccggcgcugccugaagccggugauccugacggacgggcccgagcgggugauccucgccggccccauccccgucaccccggccuccgccgcgcagcgccggggccgcaucgggcggaaccccgcccaggaggacgaccaguacguguucagcggcgacccccugcgcaacgacgaggaccacgcccacuggaccgaggccaagaugcugcucgacaacaucuacacccccgaggggaucaucccgacgcuguucggccccgagcgggagaagacccaggccaucgacggcgaguuccgccugcggggggagcagcgcaagaccuucguggagcucaugcggcgcggcgaccugcccgucuggcuguccuacaagguggcgagcgccgggaucuccuacaaggaccgggaguggugcuucaccggcgagcgcaacaaccagauccucgaggagaacauggagguggagaucuggacgcgggagggggagaagaagaagcugcgccccaaguggcuggacgcccgggucuacgccgacccgauggcccucaaggacuucaaggaguucgcgagcggccgcaaguccaucacccuggacauccugaccgagaucgccagccuccccaccuaccuguccagccgggccaagcuggcccucgacaacaucgugaugcugcacaccacggagcgcggcgggaaggccuaccagcacgcgcugaacgagcuccccgagagccuggagacccugaugcucguggcccugcugggcgccaugaccgccgggaucuuccucuucuucaugcagggcaaggggaugggcaagcuguccaugggccugaucgcgaucgccgucgccagcgggcuccuguggguggccgagauccagccgcaguggaucgccgcguccaucauccuggaguucuuccucauggugcugcugguccccgagcccgagaagcagcgcaccccccaggacaaccagcucaucuacgugauccugacgauccugaccaucaucgcccucguggccgccaacgagaugggccugaucgagaagaccaagaccgacuucggguucuaccaggccaagacggagaccaccauccuggacgucgaccuccggccggcgagcgccuggacccuguacgccguggccacgaccauccugacccccaugcuccgccacaccaucgagaacacguccgccaaccugagccuggcggccaucgccaaccaggccgccgugcucaugggccuggggaagggcuggccccugcaccggauggaccucggcgucccccugcuggcgauggggugcuacucccaggugaacccgaccacccucaccgccagccuggugaugcugcucguccacuacgccaucaucggccccgggcugcaggccaaggcgacgcgcgaggcccagaagcggaccgccgccggcaucaugaagaaccccaccguggacggcaucaccgugaucgaccuggagcccaucuccuacgacccgaaguucgagaagcagcucgggcaggucaugcugcuggugcucugcgccggccagcugcugcucaugcgcacgaccugggcguucugcgaggugcugacccuggccaccgggcccauccucacgcugugggagggcaaccccgggcgguucuggaacaccaccaucgccgucagcaccgccaacaucuuccgcggcuccuaccuggccggcgcggggcucgccuucagccugaucaagaacgcccagacgccccggcgcggcaccgggaccaccggcgagacgcugggggagaaguggaagcggcagcucaacucccuggaccgcaagggcuucgaggaguacaagcggagcggcauccuggagguggaccgcaccgaggccaaguccgcccucaaggacgggagcaagaucaaguacgcggugucccggggcaccagcaagauccgcuggaucgucgagcgggggauggugaagccgaagggcaagguggucgaccuggggugcggccgcggcgggugguccuacuacauggccacccugaagaacgugaccgaggugaagggcuacacgaaggggggccccgggcacgaggagcccauccccauggccaccuacggcuggaaccucgucaagcugcacagcggcguggacguguucuacaagccgaccgagcaggucgacacccugcucugcgacaucggggagagcuccagcaaccccacgaucgaggagggccggacccugcgcgugcugaagaugguggagcccuggcucuccagcaagcccgaguucugcaucaagguccugaacccguacaugcccaccgugaucgaggagcuggagaagcugcagcgcaagcacgggggcucccucgugcggugcccccugagccgcaacuccacccacgagauguacugggucagcggcguguccgggaacaucgucagcuccgugaacacgaccagcaagaugcugcucaaccgguucaccacccgccaccggaagcccacguacgagaaggacgccgaccugggcgcggggacccgcuccgugagcaccgagaccgagaagccggacaugacgaucaucggccggcgccugcagcggcuccaggaggagcacaaggagaccuggcacuacgaccacgagaaccccuaccgcaccugggccuaccacggguccuacgaggcccccagcaccggcuccgccagcuccauggucaacggcguggugaagcugcugacgaagccgugggacgucgugcccauggugacccagcucgccaugaccgacaccacgcccuucgggcagcagcgggucuucaaggagaagguggacacccgcaccccccagccgaagcccggcacccggguggucaugacgaccaccgcgaacuggcugugggcccugcucgggcgcaagaagaacccccggcugugcacccgcgaggaguucaucagcaaggugcggagcaacgccgccaucggcgccguguuccaggaggagcagggguggacguccgcgagcgaggccgucaacgacucccgcuucugggagcugguggacaaggagcgggcccuccaccaggagggcaagugcgagagcugcguguacaacaugaugggcaagcgcgagaagaagcugggggaguucggccgggccaaggggucccgcgccaucugguacauguggcugggcgcgcgcuuccucgaguucgaggcccugggguuccugaacgaggaccacugguucggccgggagaacagcugguccggcgucgagggggagggccuccaccgccugggguacauccuggaggacaucgacaagaaggacggcgaccucaucuacgccgacgacaccgccggcugggacacccggaucaccgaggacgaccugcugaacgaggagcucaucacggagcagauggcgccccaccacaagauccuggccaaggccaucuucaagcugaccuaccagaacaagguggugaagguccuccgcccgacccccaagggggccgugauggacaucaucagccggaaggaccagcgcggcuccgggcaggugggcaccuacgggcugaacaccuucacgaacauggagguccagcugauccggcagauggaggccgagggcgugaucacccgcgacgacaugcacaaccccaagggccucaaggagcggguggagaaguggcugaaggagugcggggucgaccgccugaagcggauggcgaucagcggcgacgacugcguggugaagccccucgacgagcgcuucuccaccagccugcuguuccucaacgacauggggaagguccggaaggacaucccgcagugggagcccuccaagggcuggaagaacuggcaggaggugcccuucugcagccaccacuuccacaagaucuucaugaaggacgggcgcucccuggugguccccugccggaaccaggacgagcugaucggccgcgcccggaucagccagggcgccggguggucccuccgcgagaccgccugccugggcaaggccuacgcgcagauguggagccugauguacuuccaccggcgcgaccuccgccuggccagcauggccaucugcuccgccgugccgacggagugguuccccaccagccggaccaccugguccauccacgcccaccaccaguggaugacgaccgaggacaugcugaagguguggaaccgcgucuggaucgaggacaaccccaacaugaucgacaagacccccgugcacagcugggaggacaucccguaccucgggaagcgggaggaccuguggugcggcucccugaucgggcucagcucccgcgcgaccugggccaagaacauccacacggccaucacccaggugcggaaccugaucggcaaggaggaguacgucgacuacaugcccgugaugaagcgcuacagcgcccacuucgaguccgagggcgugcuguga

SEQ ID NO: 10434 - RNA, 9867 nt, Artificial Sequence
  derived and/or modified CDS sequence (opt1) from DENV-4__GQ868594__SS-prME
agcaccaugacccugcucugccugauccccacggugauggccuuccaccuguccacccgcgacggcgagccccucaugaucguggccaagcacgagcgggggcgcccccugcuguucaagaccaccgagggcaucaacaagugcacgcucaucgccauggaccugggggagaugugcgaggacaccgugaccuacgagugcccccugcucgugaacaccgagcccgaggacaucgacugcuggugcaaccugacgagcgccugggugauguacgggacgugcacccaguccggggagcggcgccgggagaagcgcagcguggcccugacgccccacuccggcaugggccucgagacccgggccgagaccuggaugagcuccgagggggccuggaagcacgcgcagcgcguggagagcuggauccugcggaaccccggcuucgcccugcucgccggguucauggccuacaugaucggccagaccgggauccagcgcaccguguucuucgugcugaugaugcugguggcgcccuccuacggcaugcggugcgugggcguggggaaccgcgacuucguggagggcgugagcgggggcgccuggguggaccucgugcuggagcacggcgggugcgucacgaccauggcccagggcaagcccacccuggacuucgagcucaucaagaccacggccaaggagguggcccugcugcggaccuacugcaucgaggcguccaucagcaacaucaccaccgccacgcgcugcccgacccagggggagcccuaccucaaggaggagcaggaccagcaguacaucugccggcgcgacguggucgaccggggcugggggaacggcugcggccuguucgggaagggcgggguggugaccugcgccaaguucuccugcagcggcaagaucaccgggaaccugguccagaucgagaaccucgaguacacggugguggucaccgugcacaacggcgacacccacgccgucggcaacgacauccccaaccacggggugaccgccacgaucacgccccggucccccagcguggaggucaagcugcccgacuacggcgagcugacccucgacugcgagccccgguccgggaucgacuucaacgagaugauccugaugaagaugaagaagaagaccuggcuggugcacaagcagugguuccucgaccugccccugccgugggcggccggcgccgacacgagcgaggugcacuggaacuacaaggagcgcauggucaccuucaaggugccccacgccaagcggcaggacgugaucguccucgggucccaggagggcgccaugcacagcgcgcugaccggcgccaccgagguggacagcggggacggcaaccacauguucgccgggcaccugaagugcaaggugcgcauggagaagcuccgcaucaagggcauguccuacaccaugugcagcggcaaguucuccaucgacaaggagauggccgagacgcagcacgggaccaccgucgugaaggugaaguacgagggcgccggggcgcccugcaagguccccaucgagauccgggacgugaacaaggagaagguggucggccgcaucaucagcuccaccccguucgccgaguacacgaacagcgugaccaacaucgagcuggagccgcccuucggggacuccuacaucgugaucggcgucggcgacagcgcccugacccuccacugguuccggaagggguccagcaucggcaagaugcuggaguccaccuaccgcggggccaagcggauggcgauccugggcgagacggccugggacuucgggagcgugggcggccuccugaccucccuggggaaggccgugcaccaggucuucggcagcguguacaccaccauguucgggggcguguccuggaugguccgcauccucaucggguuccuggugcuguggaucggcacgaacagccggaacaccuccauggccaugaccugcaucgccgugggcgggaucacccuguuccucggcuucacgguccacgcggacaccgggugcgccgugagcugguccggcaaggagcugaagugcgggagcggcaucuucgugaucgacaacguccacaccuggaccgagcaguacaaguuccagcccgagagcccggcccgccuggccuccgccauccucaacgcgcacaaggacggcgugugcgggauccggagcacgacccgccuggagaacaucauguggaagcagaucaccaacgagcugaacuacgugcucugggagggcgggcacgaccugaccgucguggccggcgacgugaagggcguccuguccaaggggaagcgggcccucgcgccgcccgugaacgaccugaaguacagcuggaagacguggggcaaggccaagaucuucacccccgaggcgaagaacuccaccuuccugaucgacgggccggacaccagcgagugccccaacgagcgccgggccuggaacuuccucgagguggaggacuacggcuucgggauguucacgaccaacaucuggaugaaguuccgcgagggcuccagcgaggucugcgaccaccggcugauguccgccgccaucaaggaccagaaggcggugcacgccgacaugggcuacuggaucgagagcuccaagaaccagaccuggcagaucgagaaggccagccugaucgaggugaagaccugccucuggcccaagacgcacacccugugguccaacgggguccuggagagccagaugcucaucccgaaggccuacgccggccccuucucccagcacaacuaccgccagggguacgcgacccagaccgugggccccuggcaccuggggaagcuggagaucgacuucggcgagugccccggcacgaccgugaccauccaggaggacugcgaccaccgggggccgagccuccgcaccaccacggccuccggcaagcuggucacccaguggugcugccggagcugcaccaugccgccccugcgcuuccucggggaggacggcugcugguacgggauggagauccgcccccugagcgagaaggaggagaacauggugaagucccaggugagcgccggccagggcaccuccgagacguucagcauggggcugcucugccugacccuguucgucgaggagugccuccggcgccgggugacccgcaagcacaugauccuggucguggugaccacgcugugcgccaucauccucggcgggcugaccuggauggaccugcuccgggcccugaucaugcugggcgacaccauguccggccgcaugggcgggcagauccaccucgcgaucauggccgucuucaagaugagcccgggguacgugcugggcaucuuccugcggaagcucaccucccgcgagacggcccugauggugaucgggauggccaugaccaccguccugagcaucccccacgaccucauggaguucaucgacggcaucucccugggccugauccuccugaagauggugacccacuucgacaacacccagguggggacccuggcccucagccugaccuucauccgguccaccaugccccuggucauggcguggcgcacgaucauggccguccucuucguggucacccugaucccccugugccggaccagcugccuccagaagcagucccacuggguggagaucaccgcccugauccugggcgcccaggcgcucccgguguaccugaugacgcugaugaagggggccagcaagcgcuccuggccccucaacgagggcaucauggccgucgggcuggugagccugcucggcuccgcccugcugaagaacgacgugccccucgccggccccauggucgcgggcgggcugcugcucgccgccuacgugaugagcggguccagcgccgaccugagccuggagaaggccgcgaacgugcagugggacgagauggccgacaucaccggguccagcccgaucaucgaggucaagcaggacgaggacggguccuucagcauccgggacaucgaggagaccaacaugaucacccuccuggugaagcuggcccucaucacgguguccggccuguacccccuggccauccccgucaccaugacccucugguacauguggcaggucaagacccagcgcagcggcgcccugugggacgugcccuccccggcggccgcccagaaggccacgcugaccgagggggucuaccggaucaugcagcgcggccucuucgggaagacccaggugggcguggggauccacauggagggcgucuuccacaccauguggcacgugacgcggggcagcgugaucugccacgagaccgggcgccuggagcccuccugggccgacguccggaacgacaugaucagcuacggcgggggcuggcgccugggcgacaagugggacaaggaggaggacguccaggugcucgcgaucgagcccgggaagaaccccaagcacguccagaccaagccgggccuguucaagacccugaccggggagaucggcgccgugacgcucgacuucaagcccgggaccuccggcagccccaucaucaaccggaagggcaaggugaucgggcuguacggcaacggggucgugaccaaguccggcgacuacgugagcgccaucacccaggccgagcgcacgggggagccggacuacgaggucgacgaggacaucuuccgcaagaagcggcugaccaucauggaccuccaccccggcgcgggcaagaccaagcgcauccugcccuccaucgugcgggaggcccugaagcgccggcugcgcacccucauccuggcccccacgcggguggucgccgccgagauggaggaggcgcugcgcgggcucccgauccgguaccagacccccgccgucaagagcgagcacaccggccgcgagaucguggaccugaugugccacgccaccuucacgacccggcugcucuccagcacccgcguccccaacuacaaccugaucgugauggacgaggcccacuucaccgaccccuccagcguggccgcgcggggguacaucagcacgcgcgucgagaugggcgaggccgccgccaucuucaugaccgccaccccgcccggggcgaccgaccccuucccccaguccaacagcccgaucgaggacaucgagcgggagauccccgagcgcuccuggaacacgggcuucgacuggaucaccgacuaccagggcaagaccgugugguucguccccagcaucaaggccgggaacgacaucgccaacugccugcggaaguccggcaagaaggugauccagcucagccgcaagaccuucgacacggaguaccccaagaccaagcugaccgacugggacuucguggucaccacggacaucuccgagaugggggccaacuuccgggcgggccgcgugaucgacccgcgccggugccugaagcccgugaucagcaccgacgggcccgagcgcgucauccucgccggccccaucccggugacccccgccuccgccgcccagcggcgcggccggaucgggcgcaaccccgcgcaggaggacgaccaguacguguucagcggcgacccccugaagaacgacgaggaccacgcccacuggaccgaggccaagaugcugcucgacaacaucuacacgccggaggggaucauccccacccuguucggccccgagcgggagaagaaccaggccaucgacggcgaguuccgccugcgcggggagcagcgcaagaccuucgucgagcucaugcggcgcggcgaccugcccguguggcuguccuacaagguggccagcgcggggaucuccuacaaggaccgggaguggugcuucaccggcgagcgcaacaaccagauccucgaggagaacauggaggucgagaucuggacgcgggagggggagaagaagaagcugcgcccgaaguggcuggacgcccggguguacgccgaccccauggcccucaaggacuucaaggaguucgccagcggccgcaaguccaucacccuggacauccugaccgagaucgcgagccuccccaccuaccuguccagccgggccaagcuggcccucgacaacaucgugaugcugcacacgaccgagcgcggcgggaaggccuaccagcacgcgcugaacgagcucccggagucccuggagacccugaugcucgucgcccugcugggcgccaugaccgccgggaucuuccucuucuucaugcagggcaaggggaucggcaagcugagcaugggccugaucgccaucgcgguggccagcgggcuccuguggguggccgagauccagccccaguggaucgccgccuccaucauccuggaguucuuccucaugguccugcugauccccgagcccgagaagcagcggaccccgcaggacaaccagcucaucuacgugauccugacgauccugaccaucaucggccucaucgcggccaacgagauggggcugaucgagaagaccaagaccgacuucggcuucuaccaggugaagacggagaccaccauccuggacgucgaccuccgccccgccagcgccuggacccuguacgccguggcgacgaccauccugacccccaugcuccgccacaccaucgagaacacguccgccaaccugagccuggccgccaucgccaaccaggcggccgugcucauggggcugggcaagggcuggccccugcaccggauggaccucggggucccgcugcuggccaugggcugcuacucccaggugaaccccaccacccucaucgccagccuggugaugcugcucguccacuacgcgaucaucgggcccggccugcaggccaaggccacccgcgaggcccagaagcggacggccgcgggcaucaugaagaaccccaccguggacgggaucaccgugaucgaccuggagccgaucuccuacgaccccaaguucgagaagcagcucggccaggucaugcugcuggugcucugcgccgggcagcugcugcucaugcgcaccacgugggccuucugcgaggugcugacccuggccaccggccccguccucacccugugggaggggaaccccggccgguucuggaacacgaccaucgccgugagcaccgcgaacaucuuccgcggcuccuaccuggccggggccggccucgccuucagccugaucaagaacgcccagaccccgcggcgcgggacgggcaccaccggggagacccugggcgagaaguggaagcggcagcucaacucccuggaccgcaaggaguucgaggaguacaagcggagcggcauccuggagguggaccgcacggaggcgaaguccgcccucaaggacgggagcaagaucaagcacgccgucucccggggcagcuccaagauccgcuggaucguggagcgggggauggugaagcccaagggcaaggucguggaccuggggugcggccgcggcggguggagcuacuacauggccacccugaagaacgugaccgaggucaagggcuacaccaagggcggccccgggcacgaggagcccaucccgauggcgacguacggcuggaaccucgugaagcugcacuccggcguggacgucuucuacaagcccaccgagcaggucgacacccugcucugcgacaucggggagagcagcuccaaccccaccaucgaggagggccggacccugcgcgugcugaagauggucgagcccuggcucagcuccaagccggaguucugcaucaaggugcugaaccccuacaugcccacggugaucgaggagcuggagaagcugcagcggaagcacgggggcagccucguccgcugcccccugucccgcaacagcacccacgagauguacuggguguccggcgucagcgggaacaucguguccagcgugaacaccaccuccaagaugcugcucaaccgguucacgacccgccaccggaagccgaccuacgagaaggacgucgaccugggcgccgggacccgcagcguguccacggagaccgagaagcccgacaugaccaucaucggccggcgccugcagcggcuccaggaggagcacaaggagaccuggcacuacgaccaggagaaccccuaccgcacgugggccuaccacgggagcuacgaggccccguccaccggcagcgccuccagcauggugaacggcgucgugaagcugcugaccaagcccugggacgugauccccauggucacccagcucgcgaugacggacaccacccccuucgggcagcagcggguguucaaggagaagguggacacccgcacgccgcagcccaagcccggcacccggauggucaugaccaccacggccaacuggcugugggcccugcucgggaagaagaagaacccccgccugugcacccgggaggaguucaucuccaaggugcgcagcaacgccgccaucggcgcgguguuccaggaggagcagggguggaccagcgccuccgaggccgucaacgacagccgguucugggagcugguggacaaggagcgcgcccuccaccaggagggcaagugcgaguccugcguguacaacaugaugggcaagcgggagaagaagcugggggaguucggccgcgccaaggggagccgggcgaucugguacauguggcugggcgcccgcuuccucgaguucgaggcccugggguuccugaacgaggaccacugguucggccgggagaacuccuggagcggcgucgagggggagggccuccaccgccugggguacauccuggaggacaucgacaagaaggacggcgaccucaucuacgccgacgacaccgcgggcugggacacgcgcaucaccgaggacgaccugcugaacgaggagcucaucaccgagcagauggccccgcaccacaagauccuggccaaggccaucuucaagcugaccuaccagaacaagguggugaagguccuccggcccacgcccaagggggccgugauggacaucaucucccgcaaggaccagcggggcagcggccaggugggcaccuacgggcugaacaccuucaccaacauggagguccagcugauccgccagauggaggcggagggcgugaucacgcaggacgacaugcacaaccccaagggccucaaggagcggguggagaaguggcugaaggagugcggggucgaccgccugaagcggauggccaucuccggcgacgacugcguggugaagccgcucgacgagcgcuucagcaccucccugcuguuccucaacgacauggggaagguccggaaggacaucccccagugggagcccagcaagggcuggaagaacuggcaggaggugcccuucugcucccaccacuuccacaagaucuucaugaaggacgggcgcagccugguggucccgugccggaaccaggacgagcugaucggccgcgcccggaucucccagggcgccggguggagccuccgcgagaccgccugccugggcaaggcguacgcccagauguggucccugauguacuuccaccggcgcgaccuccggcuggccagcauggccaucugcagcgccgugcccaccgagugguuccccaccucccgcacgaccuggagcauccacgcgcaccaccaguggaugaccaccgaggacaugcugaagguguggaaccgggucuggaucgaggacaaccccaacaugacggacaagaccccggugcacuccugggaggacauccccuaccucgggaagcgcgaggaccuguggugcggcagccugaucgggcucuccagccgcgccaccugggccaagaacauccacaccgccaucacccaggugcggaaccugaucggcaaggaggaguacgucgacuacaugcccgugaugaagcgcuacuccgcccccuucgagagcgagggcgugcuguga

SEQ ID NO: 10435 - RNA, 9867 nt, Artificial Sequence
  derived and/or modified CDS sequence (opt1) from DENV-4__FJ024424__SS-prME
agcaccaucacccugcucugccugauccccacggugauggccuuccaccuguccacccgcgacggcgagccgcucaugaucgucgccaagcacgagcgggggcgcccccugcuguucaagaccaccgagggcaucaacaagugcacgcucaucgcgauggaccugggggagaugugcgaggacaccgugaccuacaagugcccccugcucgugaacaccgagcccgaggacaucgacugcuggugcaaccugacgagcaccugggucauguacggcaccugcacccaguccggggagcggcgccgggagaagcgcagcguggcccugacgccgcacuccggcaugggccucgagacccgggccgagaccuggaugagcuccgagggggccuggaagcacgcccagcgcguggagagcuggauccugcggaaccccggcuucgcgcugcucgccggguucauggccuacaugaucggccagaccgggauccagcgcacggucuucuucgugcugaugaugcugguggcccccuccuacggcaugcggugcgucggcguggggaaccgcgacuucguggagggcgucagcgggggcgcguggguggaccucgugcuggagcacggcgggugcgucaccaccauggcccagggcaagcccacccuggacuucgagcucacgaagaccaccgccaaggagguggcccugcugcggaccuacugcaucgaggccuccaucagcaacaucacgaccgcgacccgcugcccgacccagggggagcccuaccucaaggaggagcaggaccagcaguacaucugccggcgcgacguggucgaccggggcugggggaacggcugcggccuguucgggaagggcgggguggugacgugcgccaaguucuccugcagcggcaagaucaccgggaaccugguccagaucgagaaccucgaguacaccgugguggucaccgugcacaacggcgacacgcacgccgucggcaacgacaccuccaaccacggggugaccaccacgaucaccccccgcagccccuccguggaggucaagcugccggacuacggcgagcugacccucgacugcgagccccggagcgggaucgacuucaacgagaugauccugaugaagaugaagaagaagaccuggcuggugcacaagcagugguuccucgaccugccccugcccuggaccgccggcgccgacacguccgaggugcacuggaacuacaaggagcgcauggucaccuucaaggugccgcacgcgaagcggcaggacgugaccguccucgggagccaggagggcgccaugcacagcgcccuggccggcgccaccgagguggacuccggggacggcaaccacauguucgcggggcaccugaagugcaaggugcgcauggagaagcuccgcaucaagggcaugagcuacacgaugugcuccggcaaguucagcaucgacaaggagauggccgagacccagcacgggaccaccgucgugaaggugaaguacgagggcgccggggcccccugcaagguccccaucgagauccgggacgugaacaaggagaagguggucggccgcgugaucuccagcacgccccuggccgagaacaccaacuccgugaccaacaucgagcuggagccgcccuucggggacagcuacaucgucaucggcgugggcaacuccgcgcucacccugcacugguuccggaaggggagcuccaucggcaagauguucgagagcacguaccgcggggccaagcggauggccauccugggcgagaccgccugggacuucggguccgugggcggccucuucaccagccuggggaaggcgguccaccagguguucggcuccguguacaccacgauguucgggggcgucagcuggaugauccgcauccugaucggguuccucgugcuguggaucggcaccaacucccggaacaccagcauggccaugaccugcaucgccgugggcgggaucacgcuguuccugggcuucaccguccaggccgacauggggugcgugguguccuggagcggcaaggagcucaagugcgggagcggcaucuucgucguggacaacgugcacaccuggaccgagcaguacaaguuccagcccgagucccccgcccgccuggcgagcgccauccugaacgcccacaaggacggcgucugcgggauccgguccacgacccgccucgagaacgugauguggaagcagaucaccaacgagcugaacuacgugcugugggagggcgggcacgaccucaccgucguggccggcgacgugaagggcguccugacgaaggggaagcgggcccugaccccgcccgugagcgaccucaaguacuccuggaagaccuggggcaaggcgaagaucuucacccccgaggcccgcaacagcacguuccugaucgacgggcccgacaccuccgagugcccgaacgagcggcgcgccuggaacagccuggagguggaggacuacggcuucgggauguucaccaccaacaucuggaugaaguuccgggagggcuccagcgaggucugcgaccaccgccucauguccgccgccaucaaggaccagaaggcggugcacgccgacaugggcuacuggaucgagagcuccaagaaccagacguggcagaucgagaaggccagccugaucgaggugaagaccugccuguggcccaagacccacacccucugguccaacgggguccuggagagccagaugcugauccccaaguccuacgccggcccguucagccagcacaacuaccggcagggguacgcgacccagacggugggccccuggcaccucgggaagcuggagaucgacuucggcgagugccccggcaccaccgugaccauccaggaggacugcgaccaccgcgggcccagccugcggacgaccaccgccuccggcaagcucgucacccaguggugcugccgcagcugcacgaugccgccccugcgcuuccugggggaggacggcugcugguacgggauggagauccggccccucuccgagaaggaggagaacauggugaagagccaggucgccgccggccagggcaccuccgagaccuucagcauggggcugcugugccucacccuguucguggaggagugccugcgccggcgcgugacgcggaagcacaugauccucgccgucgugaucacccugugcgcgaucauccugggcgggcucaccuggauggaccugcugcgcgcccucaucaugcugggcgacaccauguccggccggaucgggggccagacgcaccuggccaucauggccguguucaagaugagccccggguacguccucggcguguuccugcgcaagcugaccucccgggagaccgcccucauggugaucgggauggcgaugaccacgacccugagcaucccgcacgaccugauggagcucaucgacggcaucucccugggccugauccuccugaagaucgucacccaguucgacaacacccagguggggacgcuggcccucagccugaccuucauccgcuccaccaugagccuggugauggccuggcggaccaucauggccguccucuucguggugacgcugaucccccugugccgcaccuccugccuccagaagcagagccacugggucgagaucaccgcccugauccugggcgcgcaggcccuccccguguaccugaugacccugaugaagggggccucccggcgcagcuggccccucaacgagggcaucauggccguggggcuggucucccugcucggcagcgcgcugcugaagaacgacgugccgcucgccggccccaugguggccgggggccugcugcucgccgccuacgucaugagcggguccagcgcggaccugucccuggagaaggccgccaacgugcagugggacgagauggccgacaucacgggcagcucccccaucaucgaggugaagcaggacgaggacgggagcuucuccauccgggacgucgaggagaccaacaugaucacccuccuggugaagcuggcccucaucaccgugagcggccuguacccccuggcgaucccggucacgaugacccucugguacauguggcaggugaagacccagcgcuccggcgcccugugggacgugcccagccccgccgccacccagaaggccgcgcuguccgagggggucuaccggaucaugcagcgcggccucuucgggaagacccaggugggcguggggauccacauggagggcgucuuccacacgauguggcacgugacccggggcagcgugaucugccacgagaccgggcgccuggagcccuccugggccgacguccggaacgacaugaucagcuacggcgggggcuggcgccugggcgacaagugggacaaggaggaggacgugcaggugcucgccaucgagccggggaagaaccccaagcacguccagaccaagcccggccuguucaagacgcugaccggggagaucggcgccgugacccucgacuucaagcccgggaccuccggcagcccgaucaucaaccgcaagggcaaggugaucgggcuguacggcaacggggucgugacgaaguccggcgacuacgugagcgccaucacccaggcggagcggaucggggagcccgacuacgaggucgacgaggacaucuuccgcaagaagcggcugaccaucauggaccuccaccccggcgccggcaagaccaagcgcauccugccguccaucgugcgggaggcccugaagcgccggcugcgcacgcucauccuggcccccacccggguggucgcggccgagauggaggaggcccugcgcgggcuccccauccgguaccagacccccgccgugaagagcgagcacaccggccgcgagaucguggaccugaugugccacgccacguucaccacccggcugcucagcuccacccgcgucccgaacuacaaccugaucgugauggacgaggcgcacuucacggaccccagcuccgucgccgcccggggguacaucagcacccgcguggagaugggcgaggccgccgcgaucuucaugaccgccaccccccccggggccacggacccguucccccaguccaacagccccaucgaggacaucgagcgggagauccccgagcgcuccuggaacaccggcuucgacuggaucaccgacuaccagggcaagaccgugugguucgucccgagcaucaaggccgggaacgacaucgccaacugccugcggaaguccggcaagaaggugauccagcucagccgcaagacguucgacaccgaguaccccaagaccaagcugaccgacugggacuucguggucacgaccgacaucuccgagaugggggcgaacuuccgcgccggccgggugaucgacccccgccggugccugaagcccgugauccucaccgacgggccggagcgcgucauccuggccggccccauccccgugacccccgccagcgcggcccagcggcgcggccggaucgggcgcaacccgacgcaggaggacgaccaguacguguucuccggcgacccccugaagaacgacgaggaccacgcccacuggaccgaggccaagaugcuccuggacaacaucuacacccccgaggggaucauccccacccuguucggcccggagcgggagaagacgcaggccaucgacggcgaguuccgccuccggggggagcagcgcaagaccuucgucgagcugaugcggcgcggcgaccugcccguguggcucagcuacaagguggcguccgccgggaucagcuacaaggaccgggaguggugcuucaccggcgagcgcaacaaccagauccuggaggagaacauggaggucgagaucuggacccgggagggggagaagaagaagcugcgcccccgguggcucgacgcccgcguguacgccgaccccauggcccugaaggacuucaaggaguucgcguccggccggaagagcaucacccuggacauccucacggagaucgccucccugccgaccuaccugagcagccgcgccaagcucgcccuggacaacaucgugaugcugcacaccaccgagcgcggcgggcgggccuaccagcacgcgcucaacgagcugcccgagucccuggagacgcucaugcuggucgcccugcucggcgccaugaccgccgggaucuuccuguucuucaugcagggcaaggggaucggcaagcugagcaugggccucaucaccaucgcgguggccuccgggcugcuguggguggccgagauccagccccaguggaucgccgccagcaucauccucgaguucuuccugaugguccugcucaucccggagcccgagaagcagcgcaccccccaggacaaccagcugaucuacgugauccugacgauccucaccaucaucggccugaucgcggccaacgagauggggcugaucgagaagaccaagaccgacuucggcuucuaccaggugaagacggagaccaccauccucgacgucgaccugcggcccgccuccgccuggacccuguacgccguggcgacgaccauccucaccccgaugcugcgccacaccaucgagaacacgagcgccaaccugucccucgccgccaucgccaaccaggcggccgugcugauggggcugggcaagggcuggccccuccaccggauggaccugggggucccccugcucgccaugggcugcuacagccaggugaaccccaccacccugaccgccucccuggugaugcuccugguccacuacgccaucaucgggccgggccugcaggcgaaggccacgcgcgaggcccagaagcggaccgccgcgggcaucaugaagaaccccaccguggacgggaucaccgugaucgaccucgagcccaucagcuacgaccccaaguucgagaagcagcugggccaggucaugcugcucgugcugugcgccgggcagcugcuccugaugcgcacgaccugggccuucugcgaggugcugacccucgccaccggcccgauccugacgcugugggaggggaaccccggccgguucuggaacaccaccaucgccgucuccaccgcgaacaucuuccgcggcagcuaccucgccggggccggccuggccuucucccugaucaagaacgcccagacgccccggcgcgggaccggcaccaccggggagacccucggcgagaaguggaagcggcagcugaacagccuggaccgcaaggaguucgaggaguacaagcgguccggcauccucgagguggaccgcacggaggcgaagagcgcccugaaggacggguccaagaucaagcacgccgugagccggggcuccagcaagauccgcuggaucgucgagcgggggauggugaagcccaagggcaagguggucgaccuggggugcggccgcggcggguggagcuacuacauggccacccucaagaacgugaccgaggugaagggcuacaccaaggggggcccggggcacgaggagcccauccccauggccacguacggcuggaaccuggucaagcugcacuccggcguggacguguucuacaagcccaccgagcaggucgacacccuccugugcgacaucggggagagcuccagcaacccgaccaucgaggagggccgcacgcugcgggugcucaagaugguggagcccuggcuguccagcaagcccgaguucugcaucaagguccugaaccccuacaugccgaccgugaucgaggagcuggagaagcuccagcgcaagcacgggggcaaccugguccggugcccccugucccgcaacagcacccacgagauguacuggguguccggcgcgagcgggaacaucguguccagcgucaacaccacguccaagaugcuccugaaccgguucaccacccgccaccggaagcccaccuacgagaaggacguggaccugggcgccgggacgcgcagcguguccaccgagaccgagaagcccgacaugaccaucaucggccggcgccuccagcggcugcaggaggagcacaaggagacguggcacuacgaccaggagaacccguaccgcaccugggccuaccacgggagcuacgaggcccccuccaccggcagcgcguccagcauggucaacggcguggugaagcugcucaccaagcccugggacaugaucccgauggucacgcagcuggccaugaccgacaccacccccuucgggcagcagcggguguucaaggagaagguggacacgcgcaccccccagcccaagccgggcacccggauggucaugaccacgaccgccaacuggcugugggcccuccuggggaagaagaagaacccccgccugugcacccgggaggaguucaucagcaaggugcgcuccaacgccgcgaucggcgccguguuccaggaggagcagggguggaccagcgccuccgaggccgucaacgacagccgguucugggagcucguggacaaggagcgcgcccugcaccaggagggcaagugcgaguccugcguguacaacaugaugggcaagcgggagaagaagcugggggaguucggccgcgcgaaggggagccgcgccaucugguacauguggcucggcgcccgguuccuggaguucgaggcccugggguuccucaacgaggaccacugguucggccgcgagaacuccuggagcggcgucgagggggagggccugcaccggcugggguacauccucgaggagaucgacaagaaggacggcgaccugauguacgccgacgacacggcgggcugggacacccgcaucaccgaggacgaccugcagaacgaggagcucaucaccgagcagauggccccccaccacaagauccuggccaaggccaucuucaagcugaccuaccagaacaagguggugaagguccuccggcccacgccgcgcggggcggugauggacaucaucucccggaaggaccagcgcggcagcgggcaggugggcaccuacgggcugaacaccuucaccaacauggagguccagcugauccggcagauggaggccgagggcgugaucacgcaggacgacaugcagaaccccaagggccucaaggagcgcguggagaaguggcugcgggagugcggggucgaccgccugaagcggauggccaucuccggcgacgacugcguggugaagccccucgacgagcgcuucgggaccagccugcuguuccucaacgacaugggcaagguccggaaggacaucccccagugggagccguccaagggguggaagaacuggcaggaggugcccuucugcagccaccacuuccacaagaucuucaugaaggacggccgcucccuggugguccccugccggaaccaggacgagcugaucggccgcgcccggaucagccagggggccggcuggucccuccgcgagaccgcgugccuggggaaggccuacgcccagauguggagccugauguacuuccaccgccgggaccuccgccuggccagcauggccaucugcuccgcggugcccaccgagugguucccgacgagccggaccaccugguccauccacgcccaccaccaguggaugaccacggaggacaugcugaagguguggaaccgcgucuggaucgaggacaaccccaacaugaucgacaagacccccgugcacagcugggaggacauccccuaccucggcaagcgggaggaccuguggugcgggucccugaucggccucagcucccgcgccaccugggccaagaacauccacaccgccaucacgcaggugcggaaccugaucggcaaggaggaguacgucgacuacaugccggugaugaagcgcuacagcgcgcccuccgagagcgagggggugcuguga

SEQ ID NO: 10436 - RNA, 9867 nt, Artificial Sequence
  derived and/or modified CDS sequence (opt1) from DENV-4__EU854295__SS-prME
agcaccaucacccugcucugccugauccccacggugauggccuuccaccuguccacccgcgacggcgagccgcucaugaucgucgccaagcacgagcgggggcgcccccugcuguucaagaccaccgagggcaucaacaagugcacgcucaucgcgauggaccugggggagaugugcgaggacaccgugaccuacaagugcccccugcucgugaacaccgagcccgaggacaucgacugcuggugcaaccugacgagcaccugggucauguacggcaccugcacccaguccggggagcggcgccgggagaagcgcagcguggcccugacgccgcacuccggcaugggccucgagacccgggccgagaccuggaugagcuccgagggggccuggaagcacgcccagcgcguggagagcuggauccugcggaaccccggcuucgcgcugcucgccggguucauggccuacaugaucggccagaccgggauccagcgcacggucuucuucgugcugaugaugcugguggcccccuccuacggcaugcggugcgucggcguggggaaccgcgacuucguggagggcgucagcgggggcgcguggguggaccucgugcuggagcacggcgggugcgucaccaccauggcccagggcaagcccacccuggacuucgagcucacgaagaccaccgccaaggagguggcccugcugcggaccuacugcaucgaggccuccaucagcaacaucacgaccgcgacccgcugcccgacccagggggagcccuaccucaaggaggagcaggaccagcaguacaucugccggcgcgacguggucgaccggggcugggggaacggcugcggccuguucgggaagggcgggguggugacgugcgccaaguucuccugcagcggcaagaucaccgggaaccugguccagaucgagaaccucgaguacaccgugguggucaccgugcacaacggcgacacgcacgccgucggcaacgacaccuccaaccacggggugaccgccaccaucacgccccgcagccccuccguggaggucaagcugccggacuacggcgagcugacccucgacugcgagccccggagcgggaucgacuucaacgagaugauccugaugaagaugaagaagaagaccuggcuggugcacaagcagugguuccucgaccugccccugcccuggaccgccggcgcggacaccuccgaggugcacuggaacuacaaggagcgcauggucacguucaaggugccgcacgccaagcggcaggacgugaccguccucgggagccaggagggcgccaugcacagcgcccuggccggcgcgaccgagguggacuccggggacggcaaccacauguucgccgggcaccugaagugcaaggugcgcauggagaagcuccgcaucaagggcaugagcuacaccaugugcuccggcaaguucagcaucgacaaggagauggccgagacgcagcacgggaccaccgucgugaaggugaaguacgagggcgccggggcccccugcaagguccccaucgagauccgggacgugaacaaggagaagguggucggccgcgugaucuccagcaccccccuggcggagaacacgaacuccgugaccaacaucgagcuggagccgcccuucggggacagcuacaucgucaucggcgugggcaacuccgcccucacccugcacugguuccggaaggggagcuccaucggcaagauguucgagagcaccuaccgcggggccaagcggauggccauccugggcgagacggcgugggacuucggguccgugggcggccucuucaccagccuggggaaggccguccaccagguguucggcuccguguacaccaccauguucgggggcgucagcuggaugauccgcauccugaucggguuccucgugcuguggaucggcacgaacucccggaacaccagcauggccaugaccugcaucgccgugggcgggaucacccuguuccugggcuucacgguccaggccgacauggggugcgugguguccuggagcggccgcgagcucaagugcgggagcggcaucuucgucguggacaacgugcacaccuggaccgagcaguacaaguuccagcccgagucccccgcgcggcuggccagcgccauccugaacgcccacaaggacggcgucugcgggauccgcuccaccacgcggcucgagaacgugauguggaagcagaucaccaacgagcugaacuacgugcugugggagggcgggcacgaccucaccgucguggccggcgacgugaagggcguccugaccaaggggaagcgcgcgcugacgccgcccgugagcgaccucaaguacuccuggaagaccuggggcaaggccaagaucuucacccccgaggcccggaacagcaccuuccugaucgacgggcccgacacguccgagugcccgaacgagcgccgggccuggaacagccuggagguggaggacuacggcuucgggauguucaccaccaacaucuggaugaaguuccgcgagggcuccagcgaggucugcgaccaccggcucauguccgccgcgaucaaggaccagaaggccgugcacgccgacaugggcuacuggaucgagagcuccaagaaccagaccuggcagaucgagaaggccagccugaucgaggugaagacgugccuguggcccaagacccacacccucugguccaacgggguccuggagagccagaugcugauccccaaguccuacgcgggcccguucagccagcacaacuaccgccagggguacgccacccagaccgugggccccuggcaccucgggaagcuggagaucgacuucggcgagugccccggcacgaccgugaccauccaggaggacugcgaccaccgggggcccagccugcgcaccacgaccgccuccggcaagcucgucacccaguggugcugccgcagcugcaccaugccgccccugcgguuccugggggaggacggcugcugguacgggauggagauccgcccccucuccgagaaggaggagaacauggugaagagccaggucgccgccggccccggcacguccgagaccuucagcauggggcugcugugccucacccuguucguggaggagugccugcggcgccgggugacccgcaagcacaugauccucgcggucgugaucacgcugugcgccaucauccugggcgggcucaccuggauggaccugcugcgggcccucaucaugcugggcgacaccauguccggccgcaucgggggccagacccaccuggccaucauggccguguucaagaugagcccgggguacguccucggcguguuccugcggaagcugacgucccgcgagaccgcgcucauggugaucgggauggccaugaccaccacgcugagcaucccccacgaccugauggagcucaucgacggcaucucccugggccugauccuccugaagaucgucacccaguucgacaacacccagguggggacccuggcccucagccugacguucauccgguccaccaugagccuggugauggccuggcgcaccaucauggccguccucuucguggugacccugaucccccugugccggacguccugccuccagaagcagagccacugggucgagaucaccgcgcugauccugggcgcccaggcccuccccguguaccugaugacccugaugaagggggccucccgccggagcuggccgcucaacgagggcaucauggcgguggggcuggucucccugcucggcagcgcccugcugaagaacgacgugccccucgccggccccaugguggccgggggccugcugcucgccgcguacgucaugagcggguccagcgccgaccugucccuggagaaggccgccaacgugcagugggacgagauggccgacaucaccggcagcucccccaucaucgaggugaagcaggacgaggacgggagcuucuccauccgcgacgucgaggagacgaacaugaucacccuccuggugaagcuggcgcucaucaccgugagcggccuguacccgcuggccauccccgucaccaugacgcucugguacauguggcaggugaagacccagcgguccggcgcccugugggacgugcccagccccgccgccacccagaaggcggcccuguccgagggggucuaccgcaucaugcagcggggccucuucgggaagacccaggugggcguggggauccacauggagggcgucuuccacaccauguggcacgugacgcgcggcagcgugaucugccacgagaccgggcggcuggagccguccugggccgacguccgcaacgacaugaucagcuacggcgggggcuggcgccugggcgacaagugggacaaggaggaggacgugcaggugcucgccaucgagcccgggaagaaccccaagcacguccagaccaagcccggccuguucaagacccugacgggggagaucggcgccgugacccucgacuucaagccggggaccuccggcagccccaucaucaaccggaagggcaaggugaucgggcuguacggcaacggggucgugaccaaguccggcgacuacgugagcgcgaucacgcaggccgagcgcaucggggagcccgacuacgaggucgacgaggacaucuuccggaagaagcgccugaccaucauggaccuccacccgggcgccggcaagaccaagcggauccugcccuccaucgugcgcgaggcccugaagcggcgccugcggacccucauccuggcgcccacgcgcguggucgccgccgagauggaggaggcccugcgggggcuccccauccgcuaccagaccccggccgugaagagcgagcacaccggccgggagaucguggaccugaugugccacgcgaccuucacgacccgccugcucagcuccacccggguccccaacuacaaccugaucgugauggacgaggcccacuucaccgaccccagcuccgucgccgcccgcggguacaucagcacgcggguggagaugggcgaggccgcggccaucuucaugaccgccacccccccgggggccaccgaccccuucccccaguccaacagccccaucgaggacaucgagcgcgagaucccggagcgguccuggaacacgggcuucgacuggaucaccgacuaccagggcaagaccgugugguucguccccagcaucaaggccgggaacgacaucgcgaacugccugcgcaaguccggcaagaaggugauccagcucagccgcaagaccuucgacacggaguaccccaagaccaagcugaccgacugggacuucguggucaccacggacaucuccgagaugggggccaacuuccgggccggccgcgugaucgacccccggcgcugccugaagccggugauccucaccgacgggcccgagcgggucauccuggccggccccauccccgugaccccggcgagcgccgcccagcgccggggccgcaucgggcggaaccccgcccaggaggacgaccaguacguguucuccggcgacccccugaagaacgacgaggaccacgcccacuggaccgaggcgaagaugcuccuggacaacaucuacacgcccgaggggaucaucccgacccuguucggccccgagcgcgagaagacccaggccaucgacggcgaguuccggcuccgcggggagcagcggaagaccuucgucgagcugaugcgccggggcgaccugcccguguggcucagcuacaagguggccuccgccgggaucagcuacaaggaccgcgaguggugcuucacgggcgagcggaacaaccagauccuggaggagaacauggaggucgagaucuggacccgcgagggggagaagaagaagcugcggccccgcuggcucgacgcccggguguacgcggacccgauggcccugaaggacuucaaggaguucgccuccggccgcaagagcaucacccuggacauccucaccgagaucgccucccugcccaccuaccugagcagccgcgccaagcucgcgcuggacaacaucgugaugcugcacacgaccgagcggggcgggcgcgccuaccagcacgcccucaacgagcugcccgagucccuggagacccucaugcuggucgcccugcucggcgcgaugaccgccgggaucuuccuguucuucaugcagggcaaggggaucggcaagcugagcaugggccucaucacgaucgccguggccuccgggcugcuguggguggccgagauccagccgcaguggaucgcggccagcaucauccucgaguucuuccugaugguccugcucauccccgagcccgagaagcagcggaccccccaggacaaccagcugaucuacgugauccugaccauccucaccaucaucggccugaucgccgccaacgagauggggcugaucgagaagacgaagaccgacuucggcuucuaccaggugaagaccgagaccacgauccucgacgucgaccugcgcccggccuccgcguggacccuguacgccguggccaccaccauccucacgcccaugcugcggcacaccaucgagaacaccagcgccaaccugucccucgccgcgaucgccaaccaggccgccgugcugauggggcugggcaagggcuggccccuccaccgcauggaccugggggucccccugcucgccaugggcugcuacagccaggugaacccgaccacgcugaccgcgucccuggugaugcuccugguccacuacgccaucaucgggcccggccugcaggccaaggccacccgggaggcgcagaagcgcaccgccgccggcaucaugaagaaccccacgguggacgggaucaccgugaucgaccucgagcccaucagcuacgacccgaaguucgagaagcagcugggccaggucaugcugcucgugcugugcgccgggcagcugcuccugaugcggaccaccugggccuucugcgaggugcugacgcucgcgaccggccccauccugacccugugggaggggaaccccggccgcuucuggaacaccacgaucgccgucuccaccgccaacaucuuccggggcagcuaccucgccggggccggccuggcguucucccugaucaagaacgcccagaccccccgccgggggaccggcacgaccggggagacccucggcgagaaguggaagcgccagcugaacagccuggaccggaaggaguucgaggaguacaagcgcuccggcauccucgagguggaccggaccgaggccaagagcgcccugaaggacggguccaagaucaagcacgccgugagccgcggcuccagcaagauccgguggaucgucgagcgcgggauggugaagccgaagggcaagguggucgaccuggggugcggccgcggcggguggagcuacuacauggcgacccucaagaacgugacggaggugaagggcuacaccaaggggggccccgggcacgaggagcccauccccauggccaccuacggcuggaaccuggucaagcugcacuccggcguggacguguucuacaagccgaccgagcaggucgacacgcuccugugcgacaucggggagagcuccagcaaccccaccaucgaggagggccggacccugcgcgugcucaagaugguggagcccuggcuguccagcaagcccgaguucugcaucaagguccugaacccguacaugcccaccgugaucgaggagcuggagaagcuccagcggaagcacgggggcaaccugguccgcugcccccugucccggaacagcacgcacgagauguacuggguguccggcgccagcgggaacaucguguccagcgucaacaccaccuccaagaugcuccugaaccgcuucaccacgcggcaccgcaagcccaccuacgagaaggacguggaccugggcgccgggacccggagcguguccaccgagacggagaagccggacaugaccaucaucggccgccggcuccagcgccugcaggaggagcacaaggagaccuggcacuacgaccaggagaaccccuaccggaccugggcguaccacgggagcuacgaggcccccuccacgggcagcgccuccagcauggucaacggcguggugaagcugcucaccaagccgugggacgucauccccauggugacccagcuggccaugaccgacacgacccccuucgggcagcagcgcguguucaaggagaaggucgacacccggaccccccagccgaagcccggcacgcgcguggugaugaccaccaccgccaacuggcugugggcgcuccuggggaagaagaagaacccccggcugugcacgcgcgaggaguucaucagcaagguccgguccaacgccgccaucggcgccguguuccaggaggagcagggguggaccagcgccuccgaggcggugaacgacagccgcuucugggagcucgucgacaaggagcgggcccugcaccaggagggcaagugcgaguccugcguguacaacaugaugggcaagcgcgagaagaagcugggggaguucggccgcgccaaggggagccgggccaucugguacauguggcucggcgcccgcuuccuggaguucgaggcgcugggguuccucaacgaggaccacugguucggccgggagaacuccuggagcggcguggagggggagggccugcaccgccugggguacauccucgaggagaucgacaagaaggacggcgaccugauguacgccgacgacaccgccggcugggacacccggaucacggaggacgaccugcagaacgaggagcucaucaccgagcagauggccccccaccacaagauccuggcgaaggccaucuucaagcugaccuaccagaacaaggucgugaaggugcuccgcccgaccccccggggggccgucauggacaucaucucccgcaaggaccagcggggcagcgggcaggugggcaccuacgggcugaacacguucaccaacauggaggugcagcugauccgccagauggaggccgagggcgucaucacccaggacgacaugcagaaccccaagggccucaaggagcggguggagaaguggcugcgcgagugcgggguggaccggcugaagcgcauggccaucuccggcgacgacugcgucgugaagccccucgacgagcgguucgggaccagccugcuguuccucaacgacaugggcaaggugcgcaaggacaucccgcagugggagcccuccaagggguggaagaacuggcaggagguccccuucugcagccaccacuuccacaagaucuucaugaaggacggccggucccugguggugcccugccgcaaccaggacgagcugaucggccgggcgcgcaucagccagggggccggcuggucccuccgcgagacggccugccuggggaaggccuacgcccagauguggagccugauguacuuccaccggcgcgaccuccggcuggcgagcauggccaucugcuccgccgucccgaccgagugguuccccaccagccgcaccacgugguccauccacgcccaccaccaguggaugaccaccgaggacaugcugaagguguggaaccggguguggaucgaggacaaccccaacaugaucgacaagacccccguccacagcugggaggacaucccguaccucggcaagcgcgaggaccuguggugcgggucccugaucggccucagcucccgggccacgugggcgaagaacauccacaccgccaucacccaggugcgcaaccugaucggcaaggaggaguacguggacuacaugcccgucaugaagcgguacagcgcccccuccgagagcgagggggugcuguga

SEQ ID NO: 10437 - RNA, 9867 nt, Artificial Sequence
  derived and/or modified CDS sequence (opt1) from DENV-4__EU854296__SS-prME
agcaccaucacccugcucugccugauccccacggugauggccuuccaccuguccacccgcgacggcgagccgcucaugaucgucgccaagcacgagcgggggcgcccccugcuguucaagaccaccgagggcaucaacaagugcacgcucaucgcgauggaccugggggagaugugcgaggacaccgugaccuacaagugcccccugcucgugaacaccgagcccgaggacaucgacugcuggugcaaccugacgagcaccugggucauguacggcaccugcacccaguccggggagcggcgccgggagaagcgcagcguggcccugacgccgcacuccggcaugggccucgagacccgggccgagaccuggaugagcuccgagggggccuggaagcacgcccagcgcguggagagcuggauccugcggaaccccggcuucgcgcugcucgccggguucauggccuacaugaucggccagaccgggauccagcgcacggucuucuucgugcugaugaugcugguggcccccuccuacggcaugcggugcgucggcguggggaaccgcgacuucguggagggcgucagcgggggcgcguggguggaccucgugcuggagcacggcgggugcgucaccaccauggcccagggcaagcccacccuggacuucgagcucacgaagaccaccgccaaggagguggcccugcugcggaccuacugcaucgaggccuccaucagcaacaucacgaccgcgacccgcugcccgacccagggggagcccuaccucaaggaggagcaggaccagcaguacaucugccggcgcgacguggucgaccggggcugggggaacggcugcggccuguucgggaagggcgggguggugacgugcgccaaguucuccugcagcggcaagaucaccgggaaccugguccagaucgagaaccucgaguacaccgugguggucaccgugcacaacggcgacacgcacgccgucggcaacgacaccuccaaccacggggugaccgccaccaucacgccccgcagccccuccguggaggucaagcugccggacuacggcgagcugacccucgacugcgagccccggagcgggaucgacuucaacgagaugauccugaugaagaugaagaagaagaccuggcuggugcacaagcagugguuccucgaccugccccugcccuggaccgccggcgcggacaccuccgaggugcacuggaacuacaaggagcgcauggucacguucaaggugccgcacgccaagcggcaggacgugaccguccucgggagccaggagggcgccaugcacagcgcccuggccggcgcgaccgagguggacuccggggacggcaaccacauguucgccgggcaccugaagugcaaggugcgcauggagaagcuccgcaucaagggcaugagcuacaccaugugcuccggcaaguucagcaucgacaaggagauggccgagacgcagcacgggaccaccgucgugaaggugaaguacgagggcgccggggcccccugcaagguccccaucgagauccgggacgugaacaaggagaagguggucggccgcgugaucuccagcaccccccuggcggagaacacgaacuccgugaccaacaucgagcuggagccgcccuucggggacagcuacaucgucaucggcgugggcaacuccgcccucacccugcacugguuccggaaggggagcuccaucggcaagauguucgagagcaccuaccgcggggccaagcggauggccauccugggcgagacggcgugggacuucggguccgugggcggccucuucaccagccuggggaaggccguccaccagguguucggcuccguguacaccaccauguucgggggcgucagcuggaugauccgcauccugaucggguuccucgugcuguggaucggcacgaacucccggaacaccagcauggccaugaccugcaucgccgugggcgggaucacccuguuccugggcuucacgguccaggccgacauggggugcgugguguccuggagcggccgcgagcucaagugcgggagcggcaucuucgucguggacaacgugcacaccuggaccgagcaguacaaguuccagcccgagucccccgcgcggcuggccagcgccauccugaacgcccacaaggacggcgucugcgggauccgcuccaccacgcggcucgagaacgugauguggaagcagaucaccaacgagcugaacuacgugcugugggagggcgggcacgaccucaccgucguggccggcgacgcgaagggcgugcugaccaaggggaagcgcgcccugacgccgcccgucagcgaccucaaguacuccuggaagaccuggggcaaggccaagaucuucacccccgaggcccggaacagcaccuuccugaucgacgggcccgacacguccgagugcccgaacgagcgccgggccuggaacagccuggagguggaggacuacggcuucgggauguucaccaccaacaucuggaugaaguuccgcgagggcuccagcgaggugugcgaccaccggcucauguccgcggccaucaaggaccagaaggccguccacgccgacaugggcuacuggaucgagagcuccaagaaccagaccuggcagaucgagaaggcgagccugaucgaggugaagacgugccuguggcccaagacccacacccucugguccaacggggugcuggagagccagaugcugauccccaaguccuacgccggcccguucagccagcacaacuaccgccagggguacgccacccagaccgucggccccuggcaccucgggaagcuggagaucgacuucggcgagugccccggcacgaccgugaccauccaggaggacugcgaccaccgggggcccagccugcgcaccacgaccgccuccggcaagcucgugacccaguggugcugccgcagcugcaccaugccgccccugcgguuccugggggaggacggcugcugguacgggauggagauccgcccccucuccgagaaggaggagaacauggucaagagccaggugacggccggccagggcaccuccgagaccuucagcauggggcugcugugccucacccuguucgucgaggagugccugcggcgccgggugacgcgcaagcacaugauccucgcgguggucaucacccugugcgccaucauccugggcgggcucaccuggauggaccugcugcgggcccucaucaugcugggcgacaccauguccggccgcaucgggggccagacgcaccuggccaucauggccguguucaagaugagccccggguacgugcucggcgucuuccugcggaagcugaccucccgcgagaccgcgcucauggugaucgggauggccaugaccacgacccugagcaucccgcacgaccugauggagcucaucgacggcaucucccugggccugauccuccugaagaucgugacccaguucgacaacacccaggucgggacgcuggcccucagccugaccuucauccgguccaccaugagccuggugauggccuggcgcaccaucauggccgugcucuucgucgugacgcugaucccccugugccggaccuccugccuccagaagcagagccacuggguggagaucaccgcgcugauccugggcgcccaggcccuccccgucuaccugaugacccugaugaagggggccucccgccggagcuggccccucaacgagggcaucauggcgguggggcuggugucccugcucggcagcgcccugcugaagaacgacgucccgcucgccggccccaugguggccgggggccugcugcucgccgcguacgugaugagcggguccagcgccgaccugucccuggagaaggccgccaacguccagugggacgagauggccgacaucacgggcagcucccccaucaucgaggugaagcaggacgaggacgggagcuucuccauccgcgacguggaggagaccaacaugaucacccuccuggucaagcuggcgcucaucaccgugagcggccuguacccccuggccaucccggugacgaugacccucugguacauguggcaggucaagacccagcgguccggcgcccugugggacgugcccagccccgccgccacccagaaggcggcccuguccgaggggguguaccgcaucaugcagcggggccucuucgggaagacccaggucggcguggggauccacauggagggcguguuccacacgauguggcacgucacccgcggcagcgugaucugccacgagaccgggcggcuggagcccuccugggccgacgugcgcaacgacaugaucagcuacggcgggggcuggcgccugggcgacaagugggacaaggaggaggacguccaggugcucgccaucgagccggggaagaaccccaagcacgugcagaccaagcccggccuguucaagacgcugaccggggagaucggcgccgucacccucgacuucaagcccgggaccuccggcagcccgaucaucaaccggaagggcaaggugaucgggcuguacggcaacgggguggucacgaaguccggcgacuacgugagcgcgaucacccaggccgagcgcaucggggagcccgacuacgagguggacgaggacaucuuccggaagaagcgccugaccaucauggaccuccaccccggcgccggcaagaccaagcggauccugccguccaucguccgcgaggcccugaagcggcgccugcggacgcucauccuggcgcccacccgcgugguggccgccgagauggaggaggcccugcgggggcuccccauccgcuaccagacccccgccgucaagagcgagcacaccggccgggagaucguggaccugaugugccacgcgacguucaccacccgccugcucagcuccacccgggugccgaacuacaaccugaucgucauggacgaggcccacuucacggaccccagcuccguggccgcccgcggguacaucagcacccgggucgagaugggcgaggccgcggccaucuucaugaccgccaccccccccggggccacggacccguucccccaguccaacagccccaucgaggacaucgagcgcgagauccccgagcgguccuggaacaccggcuucgacuggaucaccgacuaccagggcaagaccgugugguucgugccgagcaucaaggccgggaacgacaucgcgaacugccugcgcaaguccggcaagaaggucauccagcucagccgcaagacguucgacaccgaguaccccaagaccaagcugaccgacugggacuucguggugacgaccgacaucuccgagaugggggccaacuuccgggccggccgcgucaucgacccccggcgcugccugaagcccgugauccucaccgacgggccggagcgggugauccuggccggccccauccccgucacccccgcgagcgccgcccagcgccggggccgcaucgggcggaacccggcccaggaggacgaccaguacguguucuccggcgacccccugaagaacgacgaggaccacgcccacuggacggaggcgaagaugcuccuggacaacaucuacacccccgaggggaucauccccacccuguucggcccggagcgcgagaagacccaggccaucgacggcgaguuccggcuccgcggggagcagcggaagacguucguggagcugaugcgccggggcgaccugcccgucuggcucagcuacaagguggccuccgccgggaucagcuacaaggaccgcgaguggugcuucaccggcgagcggaacaaccagauccuggaggagaacauggagguggagaucuggacccgcgagggggagaagaagaagcugcggccccgcuggcucgacgcccgggucuacgcggaccccauggcccugaaggacuucaaggaguucgccuccggccgcaagagcaucacccuggacauccucaccgagaucgccucccugccgacguaccugagcagccgcgccaagcucgcgcuggacaacaucgugaugcugcacaccaccgagcggggcgggcgcgccuaccagcacgcccucaacgagcugcccgagucccuggagacccucaugcugguggcccugcucggcgcgaugacggccgggaucuuccuguucuucaugcagggcaaggggaucggcaagcugagcaugggccucaucaccaucgccgucgccuccgggcugcuguggguggccgagauccagccccaguggaucgcggccagcaucauccucgaguucuuccugauggugcugcucaucccggagcccgagaagcagcggaccccccaggacaaccagcugaucuacgucauccugaccauccucacgaucaucggccugaucgccgccaacgagauggggcugaucgagaagaccaagaccgacuucggcuucuaccaggccaagaccgagacgaccauccucgacguggaccugcgccccgcguccgccuggacccuguacgccguggccaccacgauccucaccccgaugcugcggcacaccaucgagaacaccagcgccaaccugucccucgcggccaucgccaaccaggccgccguccugauggggcugggcaagggcuggccccuccaccgcauggaccugggggugccccugcucgcgaugggcugcuacagccaggugaaccccacgacccugaccgccucccuggucaugcuccuggugcacuacgccaucaucgggccgggccugcaggccaaggcgacccgggaggcccagaagcgcacggccgccggcaucaugaagaaccccaccguggacgggaucaccgucaucgaccucgagcccaucagcuacgaccccaaguucgagaagcagcugggccaggugaugcugcucgugcugugcgccgggcagcugcuccugaugcggaccacgugggcguucugcgagguccugacccucgccaccggcccgauccugacccugugggaggggaaccccggccgcuucuggaacacgaccaucgccguguccaccgccaacaucuuccggggcagcuaccucgccggggcgggccuggccuucucccugaucaagaacgcccagaccccccgccgggggacgggcaccaucggggagacccucggcgagaaguggaagcgccagcugaacagccuggaccggaaggaguucgaggaguacaagcgcuccggcauccucgagguggaccggaccgaggccaagagcgcccugaaggacggguccaagaucaagcacgcggucagccgcggcuccagcaagauccgguggaucguggagcgcgggauggugaagcccaagggcaaggucguggaccuggggugcggccgcggcggguggagcuacuacauggccacccucaagaacgugacggaggucaagggcuacaccaaggggggcccggggcacgaggagcccauccccauggccaccuacggcuggaaccuggugaagcugcacuccggcguggacgucuucuaccggcccaccgagcagguggacacgcuccugugcgacaucggggagagcuccagcaacccgaccaucgaggagggccgcacccugcgggugcucaagauggucgagcccuggcuguccagcaagcccgaguucugcaucaaggugcugaaccccuacaugccgaccgugaucgaggagcuggagaagcuccagcgcaagcacgggggcaaccugguccggugcccccugucccgcaacagcacgcacgagauguacuggguguccggcgccagcgggaacaucgucuccagcgugaacaccaccuccaagaugcuccugaaccgguucaccacgcgccaccggaagcccaccuacgagaaggacguggaccugggcgcggggacccgcagcgucuccaccgagacggagaagcccgacaugaccaucaucggccggcgccuccagcggcugcaggaggagcacaaggagaccuggcacuacgaccaggagaacccguaccgcaccugggccuaccacgggagcuacgaggcccccuccacgggcagcgccuccagcauggugaacggcguggucaagcugcucaccaagcccugggacgugaucccgauggugacccagcuggccaugaccgacacgacccccuucgggcagcagcgggucuucaaggagaagguggacacccgcaccccccagcccaagccgggcacgcggauggugaugaccaccaccgcgaacuggcugugggcccuccuggggaagaagaagaacccccgccugugcacgcgggaggaguucaucagcaagguccgcuccaacgccgccaucggcgccguguuccaggaggagcagggguggaccagcgcguccgaggccgugaacgacagccgguucugggagcucgucgacaaggagcgcgcccugcaccaggagggcaagugcgaguccugcguguacaacaugaugggcaagcgcgagaagaagcugggggaguucggccgggccaaggggagccgcgccaucugguacauguggcucggcgcgcgguuccuggaguucgaggcccugggguuccucaacgaggaccacugguucggccgcgagaacuccuggagcggcguggagggggagggccugcaccggcugggguacauccucgaggagaucgacaagaaggacggcgaccugauguacgccgacgacaccgccggcugggacacccgcaucacggaggacgaccugcagaacgaggagcucaucaccgagcagauggcgccccaccacaagauccuggccaaggccaucuucaagcugaccuaccagaacaaggucgugaaggugcuccggcccaccccgcgcggggccgucauggacaucaucucccggaaggaccagcgcggcagcgggcaggugggcaccuacgggcugaacacguucaccaacauggaggugcagcugauccggcagauggaggccgagggcgucaucacccaggacgacaugcagaaccccaagggccucaaggagcgcguggagaaguggcugcgggagugcgggguggaccgccugaagcggauggcgaucuccggcgacgacugcgucgugaagccccucgacgagcgcuucgggaccagccugcuguuccucaacgacaugggcaaggugcggaaggacaucccccagugggagccguccaagggguggaagaacuggcaggagguccccuucugcagccaccacuuccacaagaucuucaugaaggacggccgcucccugguggugcccugccggaaccaggacgagcugaucggccgcgcccgcaucagccagggggccggcuggucccuccgggagacggccugccuggggaaggccuacgcgcagauguggagccugauguacuuccaccgccgggaccuccgccuggccagcauggccaucugcuccgccguccccaccgagugguucccgaccagccggaccacgugguccauccacgcccaccaccaguggaugaccaccgaggacaugcugaagguguggaaccgcguguggaucgaggacaaccccaacaugaucgacaagacccccguccacagcugggaggacauccccuaccucggcaagcgggaggaccuguggugcgggucccugaucggccucagcucccgcgcgacgugggccaagaacauccacaccgccaucacccaggugcggaaccugaucggcaaggaggaguacguggacuacaugccggucaugaagcgcuacagcgcccccuccgagagcgagggggugcuguga

SEQ ID NO: 10438 - RNA, 9867 nt, Artificial Sequence
  derived and/or modified CDS sequence (opt1) from DENV-4__GQ199878__SS-prME
agcaccaucacccugcucugccugauccccacggugauggccuuccaccuguccacccgcgacggcgagccgcucaugaucgucgccaagcacgagcgggggcgcccccugcuguucaagaccaccgagggcaucaacaagugcacgcucaucgcgauggaccugggggagaugugcgaggacaccgugaccuacaagugcccccugcucgugaacaccgagcccgaggacaucgacugcuggugcaaccugacgagcaccugggucauguacggcaccugcacccaguccggggagcggcgccgggagaagcgcagcguggcccugacgccgcacuccggcaugggccucgagacccgggccgagaccuggaugagcuccgagggggccuggaagcacgcccagcgcguggagagcuggauccugcggaaccccggcuucgcgcugcucgccggguucauggccuacaugaucggccagaccgggauccagcgcacggucuucuucgugcugaugaugcugguggcccccuccuacggcaugcggugcgucggcguggggaaccgcgacuucguggagggcgucagcgggggcgcguggguggaccucgugcuggagcacggcgggugcgucaccaccauggcccagggcaagcccacccuggacuucgagcucacgaagaccaccgccaaggagguggcccugcugcggaccuacugcaucgaggccuccaucagcaacaucacgaccgcgacccgcugcccgacccagggggagcccuaccucaaggaggagcaggaccagcaguacaucugccggcgcgacguggucgaccggggcugggggaacggcugcggccuguucgggaagggcgggguggugacgugcgccaaguucuccugcagcggcaagaucaccgggaaccugguccagaucgagaaccucgaguacaccgugguggucaccgugcacaacggcgacacgcacgccgucggcaacgacaccuccaaccacggggugaccgccaccaucacgccccgcagccccuccguggaggucaagcugccggacuacggcgagcugacccucgacugcgagccccggagcgggaucgacuucaacgagaugauccugaugaagaugaagaagaagaccuggcuggugcacaagcagugguuccucgaccugccccugcccuggaccgccggcgcggacaccuccgaggugcacuggaacuacaaggagcgcauggucacguucaaggugccgcacgccaagcggcaggacgugaccguccucgggagccaggagggcgccaugcacagcgcccuggccggcgcgaccgagguggacuccggggacggcaaccacauguucgccgggcaccugaagugcaaggugcgcauggagaagcuccgcaucaagggcaugagcuacaccaugugcuccggcaaguucagcaucgacaaggagauggccgagacgcagcacgggaccaccgucgugaaggugaaguacgagggcgccggggcccccugcaagguccccaucgagauccgggacgugaacaaggagaagguggucggccgcgugaucuccagcaccccccuggcggagaacacgaacuccgugaccaacaucgagcuggagccgcccuucggggacagcuacaucgucaucggcgugggcaacuccgcccucacccugcacugguuccggaaggggagcuccaucggcaagauguucgagagcaccuaccgcggggccaagcggauggccauccugggcgagacggcgugggacuucggguccgugggcggccucuucaccagccuggggaaggccguccaccagguguucggcuccguguacaccaccauguucgggggcgucagcuggaugauccgcauccugaucggguuccucgugcuguggaucggcacgaacucccggaacaccagcauggccaugaccugcaucgccgugggcgggaucacccuguuccugggcuucacgguccaggccgacauggggugcgugguguccuggagcggccgcgagcucaagugcgggagcggcaucuucgucguggacaacgugcacaccuggaccgagcaguacaaguuccagcccgagucccccgcgcggcuggccagcgccauccugaacgcccacaaggacggcgucugcgggauccgcuccaccacgcggcucgagaacgugauguggaagcagaucaccaacgagcugaacuacgugcugugggagggcgggcacgaccucaccgucguggccggcgacgugaagggcguccugaccaaggggaagcgcgcgcugacgccgcccgugagcgaccucaaguacuccuggaagaccuggggcaaggccaagaucuucacccccgaggcccggaacagcaccuuccugaucgacgggcccgacacguccgagugcccgaacgagcgccgggccuggaacagccuggagguggaggacuacggcuucgggauguucaccaccaacaucuggaugaaguuccgcgagggcuccagcgaggucugcgaccaccggcucauguccgccgcgaucaaggaccagaaggccgugcacgccgacaugggcuacuggaucgagagcuccaagaaccagaccuggcagaucgagaaggccagccugaucgaggugaagacgugccuguggcccaagacccacacccucugguccaacgggguccuggagagccagaugcugauccccaaguccuacgcgggcccguucagccagcacaacuaccgccagggguacgccacccagaccgugggccccuggcaccucgggaagcuggagaucgacuucggcgagugccccggcacgaccgugaccauccaggaggacugcgaccaccgggggcccagccugcgcaccacgaccgccuccggcaagcucgucacccaguggugcugccgcagcugcaccaugccgccccugcgguuccugggggaggacggcugcugguacgggauggagauccgcccccucuccgagaaggaggagaacauggugaagagccaggucgccgccggccagggcacguccgagaccuucagcauggggcugcugugccucacccuguucguggaggagugccugcggcgccgggugacccgcaagcacaugauccucgcggucgugaucacgcugugcgccaucauccugggcgggcucaccuggauggaccugcugcgggcccucaucaugcugggcgacaccauguccggccgcaucgggggccagacccaccuggccaucauggccguguucaagaugagccccggguacguccucggcguguuccugcggaagcugacgucccgcgagaccgcgcucauggugaucgggauggccaugaccaccacgcugagcaucccgcacgaccugauggagcucaucgacggcaucucccugggccugauccuccugaagaucgucacccaguucgacaacacccagguggggacccuggcccucagccugacguucauccgguccaccaugagccuggugauggccuggcgcaccaucauggccguccucuucguggugacccugaucccccugugccggacguccugccuccagaagcagagccacugggucgagaucaccgcgcugauccugggcgcccaggcccuccccguguaccugaugacccugaugaagggggccucccgccggagcuggccccucaacgagggcaucauggcgguggggcuggucucccugcucggcagcgcccugcugaagaacgacgugccgcucgccggccccaugguggccgggggccugcugcucgccgcguacgucaugagcggguccagcgccgaccugucccuggagaaggccgccaacgugcagugggacgagauggccgacaucaccggcagcucccccaucaucgaggugaagcaggacgaggacgggagcuucuccauccgcgacgucgaggagacgaacaugaucacccuccuggugaagcuggcgcucaucaccgugagcggccuguacccccuggccaucccggucaccaugacgcucugguacauguggcaggugaagacccagcgguccggcgcccugugggacgugcccagccccgccgccacccagaaggcggcccuguccgagggggucuaccgcaucaugcagcggggccucuucgggaagacccaggugggcguggggauccacauggagggcgucuuccacaccauguggcacgugacgcgcggcagcgugaucugccacgagaccgggcggcuggagcccuccugggccgacguccgcaacgacaugaucagcuacggcgggggcuggcgccugggcgacaagugggacaaggaggaggacgugcaggugcucgccaucgagccggggaagaaccccaagcacguccagaccaagcccggccuguucaagacccugacgggggagaucggcgccgugacccucgacuucaagcccgggaccuccggcagcccgaucaucaaccggaagggcaaggugaucgggcuguacggcaacggggucgugaccaaguccggcgacuacgugagcgcgaucacgcaggccgagcgcaucggggagcccgacuacgaggucgacgaggacaucuuccggaagaagcgccugaccaucauggaccuccaccccggcgccggcaagaccaagcggauccugccguccaucgugcgcgaggcccugaagcggcgccugcggacccucauccuggcgcccacgcgcguggucgccgccgagauggaggaggcccugcgggggcuccccauccgcuaccagacccccgccgugaagagcgagcacaccggccgggagaucguggaccugaugugccacgcgaccuucacgacccgccugcucagcuccacccgggucccgaacuacaaccugaucgugauggacgaggcccacuucaccgaccccagcuccgucgccgcccgcggguacaucagcacgcggguggagaugggcgaggccgcggccaucuucaugaccgccaccccccccggggccaccgacccguucccccaguccaacagccccaucgaggacaucgagcgcgagauccccgagcgguccuggaacacgggcuucgacuggaucaccgacuaccagggcaagaccgugugguucgucccgagcaucaaggccgggaacgacaucgcgaacugccugcgcaaguccggcaagaaggugauccagcucagccgcaagaccuucgacacggaguaccccaagaccaagcugaccgacugggacuucguggucaccacggacaucuccgagaugggggccaacuuccgggccggccgcgugaucgacccccggcgcugccugaagcccgugauccucaccgacgggccggagcgggucauccuggccggccccauccccgugacccccgcgagcgccgcccagcgccggggccgcaucgggcggaacccggcccaggaggacgaccaguacguguucuccggcgacccccugaagaacgacgaggaccacgcccacuggaccgaggcgaagaugcuccuggacaacaucuacacgcccgaggggaucauccccacccuguucggcccggagcgcgagaagacccaggccaucgacggcgaguuccggcuccgcggggagcagcggaagaccuucgucgagcugaugcgccggggcgaccugcccguguggcucagcuacaagguggccuccgccgggaucagcuacaaggaccgcgaguggugcuucacgggcgagcggaacaaccagauccuggaggagaacauggaggucgagaucuggacccgcgagggggagaagaagaagcugcggccccgcuggcucgacgcccggguguacgcggaccccauggcccugaaggacuucaaggaguucgccuccggccgcaagagcaucacccuggacauccucaccgagaucgccucccugccgaccuaccugagcagccgcgccaagcucgcgcuggacaacaucgugaugcugcacacgaccgagcggggcgggcgcgccuaccagcacgcccucaacgagcugcccgagucccuggagacccucaugcuggucgcccugcucggcgcgaugaccgccgggaucuuccuguucuucaugcagggcaaggggaucggcaagcugagcaugggccucaucacgaucgccguggccuccgggcugcuguggguggccgagauccagccccaguggaucgcggccagcaucauccucgaguucuuccugaugguccugcucaucccggagcccgagaagcagcggaccccccaggacaaccagcugaucuacgugauccugaccauccucaccaucaucggccugaucgccgccaacgagauggggcugaucgagaagacgaagaccgacuucggcuucuaccaggugaagaccgagaccacgauccucgacgucgaccugcgccccgccuccgcguggacccuguacgccguggccaccaccauccucacgccgaugcugcggcacaccaucgagaacaccagcgccaaccugucccucgccgcgaucgccaaccaggccgccgugcugauggggcugggcaagggcuggccccuccaccgcauggaccugggggucccccugcucgccaugggcugcuacagccaggugaaccccaccacgcugaccgcgucccuggugaugcuccugguccacuacgccaucaucgggccgggccugcaggccaaggccacccgggaggcgcagaagcgcaccgccgccggcaucaugaagaaccccacgguggacgggaucaccgugaucgaccucgagcccaucagcuacgaccccaaguucgagaagcagcugggccaggucaugcugcucgugcugugcgccgggcagcugcuccugaugcggaccaccugggccuucugcgaggugcugacgcucgcgaccggcccgauccugacccugugggaggggaaccccggccgcuucuggaacaccacgaucgccgucuccaccgccaacaucuuccggggcagcuaccucgccggggccggccuggcguucucccugaucaagaacgcccagaccccccgccgggggaccggcacgaccggggagacccucggcgagaaguggaagcgccagcugaacagccuggaccggaaggaguucgaggaguacaagcgcuccggcauccucgagguggaccggaccgaggccaagagcgcccugaaggacggguccaagaucaagcacgccgugagccgcggcuccagcaagauccgguggaucgucgagcgcgggauggugaagcccaagggcaagguggucgaccuggggugcggccgcggcggguggagcuacuacauggcgacccucaagaacgugacggaggugaagggcuacaccaaggggggcccggggcacgaggagcccauccccauggccaccuacggcuggaaccuggucaagcugcacuccggcguggacguguucuacaagcccaccgagcaggucgacacgcuccugugcgacaucggggagagcuccagcaacccgaccaucgaggagggccggacccugcgcgugcucaagaugguggagcccuggcuguccagcaagcccgaguucugcaucaagguccugaaccccuacaugccgaccgugaucgaggagcuggagaagcuccagcggaagcacgggggcaaccugguccgcugcccccugucccggaacagcacgcacgagauguacuggguguccggcgccagcgggaacaucguguccagcgucaacaccaccuccaagaugcuccugaaccgcuucaccacgcggcaccgcaagcccaccuacgagaaggacguggaccugggcgccgggacccggagcguguccaccgagacggagaagcccgacaugaccaucaucggccgccggcuccagcgccugcaggaggagcacaaggagaccuggcacuacgaccaggagaacccguaccggaccugggcguaccacgggagcuacgaggcccccuccacgggcagcgccuccagcauggucaacggcguggugaagcugcucaccaagcccugggacgucaucccgauggugacccagcuggccaugaccgacacgacccccuucgggcagcagcgcguguucaaggagaaggucgacacccggaccccccagcccaagccgggcacgcgcauggugaugaccaccaccgccaacuggcugugggcgcuccuggggaagaagaagaacccccggcugugcacgcgcgaggaguucaucagcaaggugcgguccaacgccgccaucggcgccgucuuccaggaggagcagggguggaccagcgccuccgaggcggugaacgacagccgcuucugggagcucguggacaaggagcgggcccugcaccaggagggcaagugcgaguccugcgucuacaacaugaugggcaagcgcgagaagaagcugggggaguucggccgcgccaaggggagccgggccaucugguacauguggcucggcgcccgcuuccuggaguucgaggcgcugggguuccucaacgaggaccacugguucggccgggagaacuccuggagcggcguggagggggagggccugcaccgccugggguacauccucgaggagaucgacaagaaggacggcgaccugauguacgccgacgacaccgccggcugggacacccggaucacggaggacgaccugcagaacgaggagcucaucaccgagcagauggccccccaccacaagauccuggcgaaggccaucuucaagcugaccuaccagaacaagguggucaaggugcuccgccccaccccgcggggggccgugauggacaucaucucccgcaaggaccagcggggcagcgggcaggucggcaccuacgggcugaacacguucaccaacauggaggugcagcugauccgccagauggaggccgagggcgugaucacccaggacgacaugcagaaccccaagggccucaaggagcgggucgagaaguggcugcgcgagugcgggguggaccggcugaagcgcauggccaucuccggcgacgacugcguggucaagccccucgacgagcgguucgggaccagccugcuguuccucaacgacaugggcaaggugcgcaaggacaucccccagugggagccguccaagggguggaagaacuggcaggaggugcccuucugcagccaccacuuccacaagaucuucaugaaggacggccggucccuggucgugcccugccgcaaccaggacgagcugaucggccgggcgcgcaucagccagggggccggcuggucccuccgcgagacggccugccuggggaaggccuacgcccagauguggagccugauguacuuccaccggcgcgaccuccggcuggcgagcauggccaucugcuccgccgugcccaccgagugguucccgaccagccgcaccacgugguccauccacgcccaccaccaguggaugaccaccgaggacaugcugaaggucuggaaccggguguggaucgaggacaaccccaacaugaucgacaagacccccgugcacagcugggaggacauccccuaccucggcaagcgcgaggaccuguggugcgggucccugaucggccucagcucccgggccacgugggcgaagaacauccacaccgccaucacccagguccgcaaccugaucggcaaggaggaguacguggacuacaugccggugaugaagcgguacagcgcccccuccgagagcgaggggguccuguga

SEQ ID NO: 10439 - RNA, 9867 nt, Artificial Sequence
  derived and/or modified CDS sequence (opt1) from DENV-4__GQ199879__SS-prME
agcaccaucacccugcucugccugauccccacggugauggccuuccaccuguccacccgcgacggcgagccgcucaugaucgucgccaagcacgagcgggggcgcccccugcuguucaagaccaccgagggcaucaacaagugcacgcucaucgcgauggaccugggggagaugugcgaggacaccgugaccuacaagugcccccugcucgugaacaccgagcccgaggacaucgacugcuggugcaaccugacgagcaccugggucauguacggcaccugcacccaguccggggagcggcgccgggagaagcgcagcguggcccugacgccgcacuccggcaugggccucgagacccgggccgagaccuggaugagcuccgagggggccuggaagcacgcccagcgcguggagagcuggauccugcggaaccccggcuucgcgcugcucgccggguucauggccuacaugaucggccagaccgggauccagcgcacggucuucuucgugcugaugaugcugguggcccccuccuacggcaugcggugcgucggcguggggaaccgcgacuucguggagggcgucagcgggggcgcguggguggaccucgugcuggagcacggcgggugcgucaccaccauggcccagggcaagcccacccuggacuucgagcucacgaagaccaccgccaaggagguggcccugcugcggaccuacugcaucgaggccuccaucagcaacaucacgaccgcgacccgcugcccgacccagggggagcccuaccucaaggaggagcaggaccagcaguacaucugccggcgcgacguggucgaccggggcugggggaacggcugcggccuguucgggaagggcgggguggugacgugcgccaaguucuccugcagcggcaagaucaccgggaaccugguccagaucgagaaccucgaguacaccgugguggucaccgugcacaacggcgacacgcacgccgucggcaacgacaccuccaaccacggggugaccgccaccaucacgccccgcagccccuccguggaggucaagcugccggacuacggcgagcugacccucgacugcgagccccggagcgggaucgacuucaacgagaugauccugaugaagaugaagaagaagaccuggcuggugcacaagcagugguuccucgaccugccccugcccuggaccgccggcgcggacaccuccgaggugcacuggaacuacaaggagcgcauggucacguucaaggugccgcacgccaagcggcaggacgugaccguccucgggagccaggagggcgccaugcacagcgcccuggccggcgcgaccgagguggacuccggggacggcaaccacauguucgccgggcaccugaagugcaaggugcgcauggagaagcuccgcaucaagggcaugagcuacaccaugugcuccggcaaguucagcaucgacaaggagauggccgagacgcagcacgggaccaccgucgugaaggugaaguacgagggcgccggggcccccugcaagguccccaucgagauccgggacgugaacaaggagaagguggucggccgcgugaucuccagcaccccccuggcggagaacacgaacuccgugaccaacaucgagcuggagccgcccuucggggacagcuacaucgucaucggcgugggcaacuccgcccucacccugcacugguuccggaaggggagcuccaucggcaagauguucgagagcaccuaccgcggggccaagcggauggccauccugggcgagacggcgugggacuucggguccgugggcggccucuucaccagccuggggaaggccguccaccagguguucggcuccguguacaccaccauguucgggggcgucagcuggauggugcgcauccugaucggguuccucgugcuguggaucggcacgaacucccggaacaccagcauggccaugaccugcaucgccgucggcgggaucacccuguuccugggcuucacggugcaggccgacauggggugcguggucuccuggagcggccgcgagcucaagugcgggagcggcaucuucgugguggacaacguccacaccuggaccgagcaguacaaguuccagcccgagucccccgcgcggcuggccagcgccauccugaacgcccacaaggacggcgugugcgggauccgcuccaccacgcggcucgagaacgugauguggaagcagaucaccaacgagcugaacuacguccugugggagggcgggcacgaccucaccgugguggccggcgacgucaagggcgugcugaccaaggggaagcgcgcgcugacgccgcccgugagcgaccucaaguacuccuggaagaccuggggcaaggccaagaucuucacccccgaggcccggaacagcaccuuccugaucgacgggcccgacacguccgagugcccgaacgagcgccgggccuggaacagccuggaggucgaggacuacggcuucgggauguucaccaccaacaucuggaugaaguuccgcgagggcuccagcgaggugugcgaccaccggcucauguccgccgcgaucaaggaccagaaggccgugcacgccgacaugggcuacuggaucgagagcuccaagaaccagaccuggcagaucgagaaggccagccugaucgaggucaagacgugccuguggcccaagacccacacccucugguccaacggggugcuggagagccagaugcugauccccaaguccuacgcgggcccguucagccagcacaacuaccgccagggguacgccacccagaccgugggccccuggcaccucgggaagcuggagaucgacuucggcgagugccccggcacgaccgucaccauccaggaggacugcgaccaccgggggcccagccugcgcaccacgaccgccuccggcaagcucgugacccaguggugcugccgcagcugcaccaugccgccccugcgguuccugggggaggacggcugcugguacgggauggagauccgcccccucaacgagaaggaggagaacauggucaagucccaggugacggccggccagggcaccagcgagaccuucuccauggggcugcugugccucacccuguucguggaggagugccugcggcgccgggucacgcgcaagcacaugauccucgugguggucaucacccugugcgccaucauccugggcgggcucaccuggauggaccugcugcgggcgcucaucaugcugggcgacaccaugagcggccgcaucgggggccagauccaccuggccaucauggccguguucaagaugucccccggguacgugcucggcgucuuccugcggaagcugacgagccgcgagaccgcccucauggugaucgggauggccaugaccaccgugcuguccaucccgcacgaccugauggagcucaucgacggcaucagccugggccugauccuccugaagaucgucacgcaguucgacaacacccagguggggacccuggcgcucucccugaccuucauccggagcacgaugccccuggugauggccuggcgcaccaucauggccguccucuucguggugacccugaucccccugugccggaccuccugccuccagaagcagagccacugggucgagaucacggcccugauccugggcgcccaggcgcuccccguguaccugaugacccugaugaagggggccucccgccggagcuggccgcucaacgagggcaucauggccguggggcuggucucccugcucggcagcgcccugcugaagaacgacgugccccucgcgggccccaugguggccgggggccugcugcucgccgccuacgucauguccgggagcagcgccgaccugucccuggagaaggcggccaacgugcagugggacgagauggccgacaucaccggcagcucccccaucaucgaggugaagcaggacgaggacgggagcuucuccauccgcgacgucgaggagaccaacaugaucacgcuccuggugaagcuggcccucaucaccgugagcggccuguacccgcuggccauccccgucaccaugacccucugguacauguggcaggugaagacgcagcgguccggcgcgcugugggacgugcccagccccgccgccacccagaaggccgcccuguccgagggggucuaccgcaucaugcagcggggccucuucgggaagacccaggugggcguggggauccacauggagggcgucuuccacaccauguggcacgugacccgcggcagcgugaucugccacgagacggggcggcuggagccguccugggcggacguccgcaacgacaugaucagcuacggcgggggcuggcgccugggcgacaagugggacaaggaggaggacgugcaggugcucgccaucgagcccgggaagaaccccaagcacguccagaccaagcccggccuguucaagacccugaccggggagaucggcgccgugacgcucgacuucaagccggggaccuccggcagccccaucaucaaccggaagggcaaggugaucgggcuguacggcaacggggucgugaccaaguccggcgacuacgugagcgccaucacccaggccgagcgcaucggggagcccgacuacgaggucgacgaggacaucuuccggaagaagcgccugacgaucauggaccuccacccgggcgcgggcaagaccaagcggauccugcccuccaucgugcgcgaggcccugaagcggcgccugcggacccucauccuggcccccacccgcguggucgccgcggagauggaggaggcccugcgggggcuccccauccgcuaccagacgccggccgugaagagcgagcacaccggccgggagaucgucgaccugaugugccacgccaccuucaccacgcgccugcucuccagcacccgggugcccaacuacaaccugaucgugauggacgaggcccacuucaccgaccccagcuccgucgcggcccgcggguacaucagcacccggguggagaugggcgaggccgccgccaucuucaugacggcgacccccccgggggccaccgaccccuucccccaguccaacagccccaucgaggacaucgagcgcgagaucccggagcgguccuggaacaccggcuucgacuggaucacggacuaccagggcaagaccgugugguucguccccagcaucaaggccgggaacgacaucgccaacugccugcgcaaguccggcaagaaggugauccagcucagccgcaagaccuucgacaccgaguaccccaagacgaagcugaccgacugggacuucguggucaccaccgacaucuccgagaugggggccaacuuccgggcgggccgcgugaucgacccccggcgcugccugaagccggugauccucacggacgggcccgagcgggucauccuggccggccccauccccgugaccccggccagcgccgcgcagcgccggggccgcaucgggcggaaccccgcccaggaggacgaccaguacguguucuccggcgacccccugaagaacgacgaggaccacgcccacuggaccgaggccaagaugcuccuggacaacaucuacacccccgaggggaucaucccgacgcuguucggccccgagcgcgagaagacccaggccaucgacggcgaguuccggcuccgcggggagcagcggaagaccuucgucgagcugaugcgccggggcgaccugcccguguggcucagcuacaagguggcguccgccgggaucagcuacaaggaccgcgaguggugcuucaccggcgagcggaacaaccagauccuggaggagaacauggaggucgagaucuggacgcgcgagggggagaagaagaagcugcggccccgcuggcucgacgcccggguguacgccgacccgauggcccugaaggacuucaaggaguucgcguccggccgcaagagcaucacccuggacauccucaccgagaucgccucccugcccaccuaccugagcucccgcgccaagcucgcccuggacaacaucgugaugcugcacaccacggagcggggcgggcgcgccuaccagcacgcgcucaacgagcugcccgagagccuggagacccucaugcuggucgcccugcucggcgccaugaccgccgggaucuuccuguucuucaugcagggcaaggggaucggcaagcugagcaugggccucaucgcgaucgccguggccuccgggcugcuguggguggccgagauccagccgcaguggaucgccgcgagcaucauccucgaguucuuccugaugguccugcucauccccgagcccgagaagcagcggaccccccaggacaaccagcugaucuacgugauccugacgauccucaccaucaucggccugaucgccgccaacgagauggggcugaucgagaagaccaagaccgacuucggcuucuaccaggugaagacggagaccaccauccucgacgucgaccugcgcccggccuccgccuggacccuguacgcgguggccacgaccauccucacccccaugcugcggcacaccaucgagaacacgagcgccaaccugucccucgccgccaucgcgaaccaggccgccgugcugauggggcugggcaagggcuggccccuccaccgcauggaccugggggucccccugcucgccaugggcugcuacagccaggugaacccgaccacccugaccgccucccuggugaugcuccugguccacuacgcgaucaucgggcccggccugcaggccaaggccacgcgggaggcccagaagcgcaccgcggccggcaucaugaagaaccccaccguggacgggaucaccgugaucgaccucgagcccaucagcuacgacccgaaguucgagaagcagcugggccaggucaugcugcucgugcugugcgccgggcagcugcuccugaugcggacgaccugggccuucugcgaggugcugacccucgccaccggccccauccugacgcugugggaggggaaccccggccgcuucuggaacaccaccaucgcggucuccaccgccaacaucuuccggggcagcuaccucgccggggccggccuggccuucucccugaucaagaacgcgcagacgccccgccgggggaccggcaccaccggggagacgcucggcgagaaguggaagcgccagcugaacagccuggaccggaaggaguucgaggaguacaagcgcuccggcauccucgagguggaccggaccgaggccaagagcgcccugaaggacggguccaagaccaagcacgccgugagccgcggcuccagcaagauccgguggaucgucgagcgcgggauggugaagccgaagggcaagguggucgaccuggggugcggccgcggcgggugguccuacuacauggccacccucaagaacgugaccgaggugaagggcuacacgaaggggggccccgggcacgaggagcccauccccauggcgaccuacggcuggaaccuggucaagcugcacagcggcguggacguguucuacaagccgaccgagcaggucgacacccuccugugcgacaucggggagagcuccagcaaccccacgaucgaggagggccggacccugcgcgugcucaagauggucgagcccuggcuguccagcaagcccgaguucugcaucaaggugcugaacccguacaugcccaccgugaucgaggagcuggagaagcuccagcggaagcacgggggcaaccugguccgcugcccccugucccggaacagcacccacgagauguacuggguguccggcgccagcgggaacaucguguccagcgucaacacgaccuccaagaugcuccugaaccgcuucaccacccggcaccgcaagcccacguacgagaaggacguggaccugggcgccgggacccggagcguguccaccgagaccgagaagccggacaugacgaucaucggccgccggcuccagcgccugcaggaggagcacaaggagaccuggcacuacgaccaggagaaccccuaccggaccugggccuaccacgggagcuacgaggcgcccuccaccggcagcgccuccagcauggucaacggcguggugaagcugcucacgaagccgugggacgucauccccauggugacccagcuggccaugaccgacaccacgcccuucgggcagcagcgcguguucaaggagaaggucgacacccggaccccccagccgaagcccggcacccgcaugaucaugacgaccaccgccaacuggcugugggcccuccuggggaagaagaagaacccccggcugugcacccgcgaggaguucaucuccaaggugcggagcaacgcggccaucggcgccguguuccaggaggagcagggguggacgagcgccuccgaggccgucaacgacagccgcuucugggagcucguggacaaggagcgggcgcugcaccaggagggcaagugcgaguccugcguguacaacaugaugggcaagcgcgagaagaagcugggggaguucggccgcgccaaggggagccgggccaucugguacauguggcucggcgcccgcuuccuggaguucgaggcccugggguuccucaacgaggaccacugguucggccgggagaacuccuggagcggcgucgagggggagggccugcaccgccugggguacauccucgaggagaucgacaagaaggacggcgaccugauguacgcggacgacaccgccggcugggacacccggaucaccgaggacgaccugcagaacgaggagcucaucacggagcagauggccccccaccacaagauccuggccaaggcgaucuucaagcugaccuaccagaacaagguggugaagguccuccgcccgaccccccggggggccgugauggacaucaucucccgcaaggaccagcggggcagcgggcaggugggcaccuacgggcugaacaccuucacgaacauggagguccagcugauccgccagauggaggccgagggcgugaucacccaggacgacaugcagaaccccaagggccucaaggagcggguggagaaguggcugcgcgagugcggggucgaccggcugaagcgcauggccaucuccggcgacgacugcguggugaagccccucgacgagcgguucgggaccagccugcuguuccucaacgacaugggcaagguccgcaaggacaucccgcagugggagcccuccaagggguggaagaacuggcaggaggugcccuucugcagccaccacuuccacaagaucuucaugaaggacggccggucccuggugguccccugccgcaaccaggacgagcugaucggccgggcccgcaucagccagggggcgggcuggucccuccgcgagaccgccugccuggggaaggccuacgcccagauguggagccugauguacuuccaccggcgcgaccuccggcuggccuccauggcgaucugcagcgccgugccgacggagugguuccccaccagccgcaccaccugguccauccacgcccaccaccaguggaugacgaccgaggacaugcugaagguguggaaccgggucuggaucgaggacaaccccaacaugaccgacaagacccccauccacagcugggaggacaucccguaccucggcaagcgcgaggaccuguggugcgggucccugaucggccucagcucccgggccacgugggccaagaacauccacaccgcgaucacccaggugcgcaaccugaucggcaaggaggaguacguggacuacaugcccgucaugaagcgguacagcgcccccuccgagagcgagggggugcuguga

SEQ ID NO: 10440 - RNA, 9867 nt, Artificial Sequence
  derived and/or modified CDS sequence (opt1) from DENV-4__GQ199880__SS-prME
agcaccaucacccugcucugccugauccccacggugauggccuuccaccuguccacccgcgacggcgagccgcucaugaucgucgccaagcacgagcgggggcgcccccugcuguucaagaccaccgagggcaucaacaagugcacgcucaucgcgauggaccugggggagaugugcgaggacaccgugaccuacaagugcccccugcucgugaacaccgagcccgaggacaucgacugcuggugcaaccugacgagcaccugggucauguacggcaccugcacccaguccggggagcggcgccgggagaagcgcagcguggcccugacgccgcacuccggcaugggccucgagacccgggccgagaccuggaugagcuccgagggggccuggaagcacgcccagcgcguggagagcuggauccugcggaaccccggcuucgcgcugcucgccggguucauggccuacaugaucggccagaccgggauccagcgcacggucuucuucgugcugaugaugcugguggcccccuccuacggcaugcggugcgucggcguggggaaccgcgacuucguggagggcgucagcgggggcgcguggguggaccucgugcuggagcacggcgggugcgucaccaccauggcccagggcaagcccacccuggacuucgagcucacgaagaccaccgccaaggagguggcccugcugcggaccuacugcaucgaggccuccaucagcaacaucacgaccgcgacccgcugcccgacccagggggagcccuaccucaaggaggagcaggaccagcaguacaucugccggcgcgacguggucgaccggggcugggggaacggcugcggccuguucgggaagggcgggguggugacgugcgccaaguucuccugcagcggcaagaucaccgggaaccugguccagaucgagaaccucgaguacaccgugguggucaccgugcacaacggcgacacgcacgccgucggcaacgacaccuccaaccacggggugaccgccaccaucacgccccgcagccccuccguggaggucaagcugccggacuacggcgagcugacccucgacugcgagccccggagcgggaucgacuucaacgagaugauccugaugaagaugaagaagaagaccuggcuggugcacaagcagugguuccucgaccugccccugcccuggaccgccggcgcggacaccuccgaggugcacuggaacuacaaggagcgcauggucacguucaaggugccgcacgccaagcggcaggacgugaccguccucgggagccaggagggcgccaugcacagcgcccuggccggcgcgaccgagguggacuccggggacggcaaccacauguucgccgggcaccugaagugcaaggugcgcauggagaagcuccgcaucaagggcaugagcuacaccaugugcuccggcaaguucagcaucgacaaggagauggccgagacgcagcacgggaccaccgucgugaaggugaaguacgagggcgccggggcccccugcaagguccccaucgagauccgggacgugaacaaggagaagguggucggccgcgugaucuccagcaccccccuggcggagaacacgaacuccgugaccaacaucgagcuggagccgcccuucggggacagcuacaucgucaucggcgugggcaacuccgcccucacccugcacugguuccggaaggggagcuccaucggcaagauguucgagagcaccuaccgcggggccaagcggauggccauccugggcgagacggcgugggacuucggguccgugggcggccucuucaccagccuggggaaggccguccaccagguguucggcuccguguacaccaccauguucgggggcgucagcuggaugauccgcauccugaucggguuccucgugcuguggaucggcacgaacucccggaacaccagcauggccaugaccugcaucgccgugggcgggaucacccuguuccugggcuucacgguccaggccgacauggggugcgugguguccuggagcggccgcgagcucaagugcgggagcggcaucuucgucguggacaacgugcacaccuggaccgagcaguacaaguuccagcccgagucccccgcgcggcuggccagcgccauccugaacgcccacaaggacggcgucugcgggauccgcuccaccacgcggcucgagaacgugauguggaagcagaucaccaacgagcugaacuacgugcugugggagggcgggcacgaccucaccgucguggccggcgacgugaagggcguccugaccaaggggaagcgcgcgcugacgccgcccgugagcgaccucaaguacuccuggaagaccuggggcaaggccaagaucuucacccccgaggcccggaacagcaccuuccugaucgacgggcccgacacguccgagugcccgaacgagcgccgggccuggaacagccuggagguggaggacuacggcuucgggauguucaccaccaacaucuggaugaaguuccgcgagggcuccagcgaggucugcgaccaccggcucauguccgccgcgaucaaggaccagaaggccgugcacgccgacaugggcuacuggaucgagagcuccaagaaccagaccuggcagaucgagaaggccagccugaucgaggugaagacgugccuguggcccaagacccacacccucugguccaacgggguccuggagagccagaugcugauccccaaguccuacgcgggcccguucagccagcacaacuaccgccagggguacgccacccagaccgugggccccuggcaccucgggaagcuggagaucgacuucggcgagugccccggcacgaccgugaccauccaggaggacugcgaccaccgggggcccagccugcgcaccacgaccgccuccggcaagcucgucacccaguggugcugccgcagcugcaccaugccgccccugcgguuccugggggaggacggcugcugguacgggauggagauccgcccccucaacgagaaggaggagaacauggugaagucccaggucacggccggccagggcaccagcgagaccuucuccauggggcugcugugccucacccuguucguggaggagugccugcggcgccgggugacgcgcaagcacaugauccucgucguggugaucacccugugcgccaucauccugggcgggcucaccuggauggaccugcugcgggcgcucaucaugcugggcgacaccaugagcggccgcaucgggggccagauccaccuggccaucauggccgucuucaagaugucccccggguacgugcucggcguguuccugcggaagcugacgagccgcgagaccgcccucauggucaucgggauggccaugaccaccgugcuguccaucccgcacgaccugauggagcucaucgacggcaucagccugggccugauccuccugaagaucgugacgcaguucgacaacacccaggucgggacccuggcgcucucccugaccuucauccggagcacgaugccccuggugauggccuggcgcaccaucauggccgugcucuucgucgugacccugaucccccugugccggaccuccugccuccagaagcagagccacuggguggagaucacggcccugauccugggcgcccaggcgcuccccgucuaccugaugacccugaugaagggggccucccgccggagcuggccgcucaacgagggcaucauggccguggggcuggugucccugcucggcagcgcccugcugaagaacgacgucccccucgcgggccccaugguggccgggggccugcugcucgccgccuacgugauguccgggagcagcgccgaccugucccuggagaaggcggccaacguccagugggacgagauggccgacaucaccggcagcucccccaucaucgaggugaagcaggacgaggacgggagcuucuccauccgcgacguggaggagaccaacaugaucacgcuccuggucaagcuggcccucaucaccgugagcggccuguacccgcuggccauccccgugaccaugacccucugguacauguggcaggucaagacgcagcgguccggcgcgcugugggacgugcccagccccgccgccacccagaaggccgcccuguccgaggggguguaccgcaucaugcagcggggccucuucgggaagacccaggucggcguggggauccacauggagggcguguuccacaccauguggcacgucacccgcggcagcgugaucugccacgagacggggcggcuggagccguccugggcggacgugcgcaacgacaugaucagcuacggcgggggcuggcgccugggcgacaagugggacaaggaggaggacguccaggugcucgccaucgagcccgggaagaaccccaagcacgugcagaccaagcccggccuguucaagacccugaccggggagaucggcgccgucacgcucgacuucaagccggggaccuccggcagccccaucaucaaccggaagggcaaggugaucgggcuguacggcaacgggguggucaccaaguccggcgacuacgugagcgccaucacccaggccgagcgcaucggggagcccgacuacgagguggacgaggacaucuuccggaagaagcgccugacgaucauggaccuccacccgggcgcgggcaagaccaagcggauccugcccuccaucguccgcgaggcccugaagcggcgccugcggacccucauccuggcccccacccgcgugguggccgcggagauggaggaggcccugcgggggcuccccauccgcuaccagacgccggccgucaagagcgagcacaccggccgggagaucguggaccugaugugccacgccaccuucaccacgcgccugcucuccagcacccggguccccaacuacaaccugaucgugauggacgaggcccacuucaccgaccccagcuccguggcggcccgcggguacaucagcacccgggucgagaugggcgaggccgccgccaucuucaugacggcgacccccccgggggccaccgaccccuucccccaguccaacagccccaucgaggacaucgagcgcgagaucccggagcgguccuggaacaccggcuucgacuggaucacggacuaccagggcaagaccgugugguucgugcccagcaucaaggccgggaacgacaucgccaacugccugcgcaaguccggcaagaaggucauccagcucagccgcaagaccuucgacaccgaguaccccaagacgaagcugaccgacugggacuucguggugaccaccgacaucuccgagaugggggccaacuuccgggcgggccgcgucaucgacccccggcgcugccugaagccggugauccucacggacgggcccgagcgggugauccuggccggccccauccccgucaccccggccagcgccgcgcagcgccggggccgcaucgggcggaaccccgcccaggaggacgaccaguacguguucuccggcgacccccugaagaacgacgaggaccacgcccacuggaccgaggccaagaugcuccuggacaacaucuacacccccgaggggaucaucccgacgcuguucggccccgagcgcgagaagacccaggccaucgacggcgaguuccggcuccgcggggagcagcggaagaccuucguggagcugaugcgccggggcgaccugcccgucuggcucagcuacaagguggcguccgccgggaucagcuacaaggaccgcgaguggugcuucaccggcgagcggaacaaccagauccuggaggagaacauggagguggagaucuggacgcgcgagggggagaagaagaagcugcggccccgcuggcucgacgcccgggucuacgccgacccgauggcccugaaggacuucaaggaguucgcguccggccgcaagagcaucacccuggacauccucaccgagaucgccucccugcccaccuaccugagcucccgcgccaagcucgcccuggacaacaucgugaugcugcacaccacggagcggggcgggcgcgccuaccagcacgcgcucaacgagcugcccgagagccuggagacccucaugcugguggcccugcucggcgccaugaccgccgggaucuuccuguucuucaugcagggcaaggggaucggcaagcugagcaugggccucaucgcgaucgccgucgccuccgggcugcuguggguggccgagauccagccgcaguggaucgccgcgagcaucauccucgaguucuuccugauggugcugcucauccccgagcccgagaagcagcggaccccccaggacaaccagcugaucuacgucauccugacgauccucaccaucaucggccugaucgccgccaacgagauggggcugaucgagaagaccaagaccgacuucggcuucuaccaggugaagacggagaccaccauccucgacguggaccugcgcccggccuccgccuggacccuguacgcggucgccacgaccauccucacccccaugcugcggcacaccaucgagaacacgagcgccaaccugucccucgccgccaucgcgaaccaggccgccgugcugauggggcugggcaagggcuggccccuccaccgcauggaccugggggugccccugcucgccaugggcugcuacagccaggucaacccgaccacccugaccgccucccuggugaugcuccuggugcacuacgcgaucaucgggcccggccugcaggccaaggccacgcgggaggcccagaagcgcaccgcggccggcaucaugaagaaccccaccgucgacgggaucaccgugaucgaccucgagcccaucagcuacgacccgaaguucgagaagcagcugggccaggugaugcugcucguccugugcgccgggcagcugcuccugaugcggacgaccugggccuucugcgaggugcugacccucgccaccggccccauccugacgcugugggaggggaaccccggccgcuucuggaacaccaccaucgcgguguccaccgccaacaucuuccggggcagcuaccucgccggggccggccuggccuucucccugaucaagaacgcgcagacgccccgccgggggaccggcaccaccggggagacgcucggcgagaaguggaagcgccagcugaacagccuggaccggaaggaguucgaggaguacaagcgcuccggcauccucgaggucgaccggaccgaggccaagagcgcccugaaggacggguccaagaccaagcacgccgugagccgcggcuccagcaagauccgguggaucguggagcgcgggauggucaagccgaagggcaaggugguggaccuggggugcggccgcggcgggugguccuacuacauggccacccucaagaacgucaccgaggugaagggcuacacgaaggggggccccgggcacgaggagcccauccccauggcgaccuacggcuggaaccuggugaagcugcacagcggcgucgacguguucuacaagccgaccgagcagguggacacccuccugugcgacaucggggagagcuccagcaaccccacgaucgaggagggccggacccugcgcguccucaagaugguggagcccuggcuguccagcaagcccgaguucugcaucaagguccugaacccguacaugcccaccgugaucgaggagcuggagaagcuccagcggaagcacgggggcaaccuggugcgcugcccccugucccggaacagcacccacgagauguacugggucuccggcgccagcgggaacaucguguccagcgugaacacgaccuccaagaugcuccugaaccgcuucaccacccggcaccgcaagcccacguacgagaaggacgucgaccugggcgccgggacccggagcguguccaccgagaccgagaagccggacaugacgaucaucggccgccggcuccagcgccugcaggaggagcacaaggagaccuggcacuacgaccaggagaaccccuaccggaccugggccuaccacgggagcuacgaggcgcccuccaccggcagcgccuccagcauggugaacggcgucgugaagcugcucacgaagccgugggacgugauccccauggucacccagcuggccaugaccgacaccacgcccuucgggcagcagcgcguguucaaggagaagguggacacccggaccccccagccgaagcccggcacccgcaugaucaugacgaccaccgccaacuggcugugggcccuccuggggaagaagaagaacccccggcugugcacccgcgaggaguucaucuccaagguccggagcaacgcggccaucggcgccguguuccaggaggagcagggguggacgagcgccuccgaggccgugaacgacagccgcuucugggagcucgucgacaaggagcgggcgcugcaccaggagggcaagugcgaguccugcguguacaacaugaugggcaagcgcgagaagaagcugggggaguucggccgcgccaaggggagccgggccaucugguacauguggcucggcgcccgcuuccuggaguucgaggcccugggguuccucaacgaggaccacugguucggccgggagaacuccuggagcggcguggagggggagggccugcaccgccugggguacauccucgaggagaucgacaagaaggacggcgaccugauguacgcggacgacaccgccggcugggacacccggaucaccgaggacgaccugcagaacgaggagcucaucacggagcagauggccccccaccacaagauccuggccaaggcgaucuucaagcugaccuaccagaacaaggucgugaaggugcuccgcccgaccccccggggggccgucauggacaucaucucccgcaaggaccagcggggcagcgggcaggugggcaccuacgggcugaacaccuucacgaacauggaggugcagcugauccgccagauggaggccgagggcgucaucacccaggacgacaugcagaaccccaagggccucaaggagcggguggagaaguggcugcgcgagugcgggguggaccggcugaagcgcauggccaucuccggcgacgacugcgucgugaagccccucgacgagcgguucgggaccagccugcuguuccucaacgacaugggcaaggugcgcaaggacaucccgcagugggagcccuccaagggguggaagaacuggcaggagguccccuucugcagccaccacuuccacaagaucuucaugaaggacggccggucccugguggugcccugccgcaaccaggacgagcugaucggccgggcccgcaucagccagggggcgggcuggucccuccgcgagaccgccugccuggggaaggccuacgcccagauguggagccugauguacuuccaccggcgcgaccuccggcuggccuccauggcgaucugcagcgccgucccgacggagugguuccccaccagccgcaccaccugguccauccacgcccaccaccaguggaugacgaccgaggacaugcugaagguguggaaccggguguggaucgaggacaaccccaacaugaccgacaagacccccauccacagcugggaggacaucccguaccucggcaagcgcgaggaccuguggugcgggucccugaucggccucagcucccgggccacgugggccaagaacauccacaccgcgaucacccagguccgcaaccugaucggcaaggaggaguacguggacuacaugcccgugaugaagcgguacagcgcccccuccgagagcgaggggguccuguga

SEQ ID NO: 10441 - RNA, 9867 nt, Artificial Sequence
  derived and/or modified CDS sequence (opt1) from DENV-4__GQ252675__SS-prME
agcaccaucacccugcucugccugauccccaccgugauggccuuccaccuguccacccgggacggcgagccgcucaugaucguggccaagcacgagcgggggcgcccccugcuguucaagaccaccgagggcaucaacaagugcacccucaucgccauggaccugggggagaugugcgaggacaccgugaccuacaagugcccccugcucgugaacaccgagcccgaggacaucgacugcuggugcaaccugaccagcaccugggugauguacgggaccugcacccaguccggggagcggcgccgggagaagcgcagcguggcccugaccccgcacuccggcaugggccucgagacccgggccgagaccuggaugagcuccgagggggccuggaagcacgcccagcgcguggagagcuggauccugcggaaccccggcuucgcgcugcucgccggguucauggccuacaugaucggccagaccgggauccagcgcaccguguucuucgugcugaugaugcugguggcccccuccuacggcaugcggugcgugggcguggggaaccgcgacuucguggagggcgucagcgggggcgcguggguggaccucgugcuggagcacggcgggugcgucaccaccauggcccagggcaagcccacccuggacuucgagcucacgaagaccaccgccaaggagguggcccugcugcggaccuacugcaucgaggccuccaucagcaacaucacgaccgcgacccgcugcccgacccagggggagcccuaccucaaggaggagcaggaccagcaguacaucugccggcgcgacguggucgaccggggcugggggaacggcugcggccuguucgggaagggcgggguggugacgugcgccaaguucuccugcagcggcaagaucaccgggaaccugguccagaucgagaaccucgaguacaccgugguggucaccgugcacaacggcgacacgcacgccgucggcaacgacaccuccaaccacggggugaccgccaccaucacgccccgcagccccuccguggaggucaagcugccggacuacggcgagcugacccucgacugcgagccccggagcgggaucgacuucaacgagaugauccugaugaagaugaagaagaagaccuggcuggugcacaagcagugguuccucgaccugccccugcccuggaccgccggcgcggacaccuccgaggugcacuggaacuacaaggagcgcauggucacguucaaggugccgcacgccaagcggcaggacgugaccguccucgggagccaggagggcgccaugcacagcgcccuggccggcgcgaccgagguggacuccggggacggcaaccacauguucgccgggcaccugaagugcaagauccgcauggagaagcuccgcaucaagggcaugagcuacaccaugugcuccggcaaguucagcaucgacaaggagauggccgagacgcagcacgggaccaccguggucaaggugaaguacgagggcgccggggcccccugcaaggugcccaucgagauccgggacgucaacaaggagaagguggugggccgcgucaucuccagcacgccccuggcggagaacacgaacuccgugaccaacaucgagcuggagccgcccuucggggacagcuacaucgugaucggcgucggcaacuccgcccucacccugcacugguuccggaaggggagcuccaucggcaagauguucgagagcaccuaccgcggggccaagcggauggccauccugggcgagacggcgugggacuucggguccgugggcggccucuucaccagccuggggaaggccgugcaccaggucuucggcuccguguacaccaccauguucgggggcgugagcuggaugauccgcauccugaucggguuccucguccuguggaucggcacgaacucccggaacaccagcauggccaugaccugcaucgccgugggcgggaucacccuguuccugggcuucacggugcaggccgacauggggugcgucguguccuggagcggccgcgagcucaagugcgggagcggcaucuucguggucgacaacgugcacaccuggaccgagcaguacaaguuccagcccgagucccccgcgcggcuggccagcgccauccugaacgcccacaaggacggcgugugcgggauccgcuccaccacgcggcucgagaacgucauguggaagcagaucaccaacgagcugaacuacgugcugugggagggcgggcacgaccucaccguggucgccggcgacgugaagggcgugcugaccaaggggaagcgcgcgcugacgccgcccgucagcgaccucaaguacuccuggaagaccuggggcaaggccaagaucuucacccccgaggcccggaacagcaccuuccugaucgacgggcccgacacguccgagugcccgaacgagcgccgggccuggaacagccuggagguggaggacuacggcuucgggauguucaccaccaacaucuggaugaaguuccgcgagggcuccagcgaggugugcgaccaccggcucauguccgccgcgaucaaggaccagaaggccguccacgccgacaugggcuacuggaucgagagcuccaagaaccagaccuggcagaucgagaaggccagccugaucgaggugaagacgugccuguggcccaagacccacacccucugguccaacggggugcuggagagccagaugcugauccccaaguccuacgcgggcccguucagccagcacaacuaccgccagggguacgccacccagaccgucggccccuggcaccucgggaagcuggagaucgacuucggcgagugccccggcacgaccgugaccauccaggaggacugcgaccaccgggggcccagccugcgcaccacgaccgccuccggcaagcucgugacccaguggugcugccgcagcugcaccaugccgccccugcgguuccugggggaggacggcugcugguacgggauggagauccgcccccucaacgagaaggaggagaacauggucaagucccaggugacggccggccagggcaccagcgagaccuucuccauggggcugcugugccucacccuguucgucgaggagugccugcggcgccgggugacgcgcaagcacaugaugcucguggucgugaucacccugugcgccaucauccugggcgggcucaccuggauggaccugcugcgggcgcucaucaugcugggcgacaccaugagcggccgcaucgggggccagauccaccuggccaucauggccguguucaagaugucccccggguacguccucggcguguuccugcggaagcugacgagccgcgagaccgcccucauggugaucgggauggccaugaccaccguccuguccaucccgcacgaccugauggagcucaucgacggcaucagccugggccugauccuccugaagacggugacccaguucgacaacacccagguggggacccuggcgcucucccugacguucauccggagcaccaugccccuggucauggccuggcgcaccaucauggccguccucuucguggucacccugaucccccugugccggacguccugccuccagaagcagagccacuggguggagaucaccgcccugauccugggcgcccaggcgcuccccguguaccugaugacccugaugaagggggccucccgccggagcuggccgcucaacgagggcaucauggccgucgggcuggugucccugcucggcagcgcccugcugaagaacgacgugccccucgcgggccccauggucgccgggggccugcugcucgccgccuacgugauguccgggagcagcgccgaccugucccuggagaaggcggccaacgugcagugggacgagauggccgacaucaccggcagcucccccaucaucgaggucaagcaggacgaggacgggagcuucuccauccgcgacguggaggagacgaacaugaucacccuccuggugaagcuggcccucaucaccgucagcggccuguacccgcuggccauccccgugaccaugacgcucugguacauguggcaggucaagacccagcgguccggcgcgcugugggacguccccagccccgccgccacccagaaggccgcccuguccgaggggguguaccgcaucaugcagcggggccucuucgggaagacccaggugggcgucgggauccacauggagggcguguuccacaccauguggcacgugacgcgcggcagcgucaucugccacgagaccgggcggcuggagccguccugggcggacgugcgcaacgacaugaucagcuacggcgggggcuggcgccugggcgacaagugggacaaggaggaggacgugcagguccucgccaucgagcccgggaagaaccccaagcacgugcagaccaagcccggccuguucaagacccugacgggggagaucggcgccgugacccucgacuucaagccggggaccuccggcagccccaucaucaacaagaagggcaaggucaucgggcuguacggcaacgggguggugaccaaguccggcgacuacgucagcgccaucacgcaggccgagcggaucggggagcccgacuacgagguggacgaggacaucuuccgcaagaagcggcugaccaucauggaccuccacccgggcgcgggcaagaccaagcgcauccugcccuccaucgugcgggaggcccugaagcgccggcugcgcacccucauccuggcccccacgcgggucguggccgcggagauggaggaggcccugcgcgggcuccccauccgguaccagaccccggccgucaagagcgagcacaccggccgcgagaucgucgaccugaugugccacgccaccuucacgacccggcugcucuccagcacccgcgugcccaacuacaaccugaucgucauggacgaggcccacuucaccgaccccagcuccguggcggcccggggguacaucagcacgcgcguggagaugggcgaggccgccgccaucuucaugaccgcgacgcccccgggggccaccgaccccuucccccaguccaacagccccaucgaggacaucgagcgggagaucccggagcgcuccuggaacacgggcuucgacuggaucaccgacuaccagggcaagaccgucugguucgugcccagcaucaaggccgggaacgacaucgccaacugccugcggaaguccggcaagaaggugauccagcucagccgcaagaccuucgacacggaguaccccaagaccaagcugaccgacugggacuucgucgugaccacggacaucuccgagaugggggccaacuuccgcgcgggccgggugaucgacccccgccggugccugaagccggucauccucaccgacgggcccgagcgcgugauccuggccggccccauccccgugaccccggccagcgccgcgcagcggcgcggccggaucgggcgcaaccccgcccaggaggacgaccaguacgucuucuccggcgacccccugaagaacgacgaggaccacgcccacuggaccgaggccaagaugcuccuggacaacaucuacacgcccgaggggaucaucccgacccuguucggccccgagcgggagaagacccaggccaucgacggcgaguuccgccuccgcggggagcagcgcaagaccuucguggagcugaugcggcgcggcgaccugcccguguggcucagcuacaaggucgcguccgccgggaucagcuacaaggaccgggaguggugcuucacgggcgagcgcaacaaccagauccuggaggagaacauggagguggagaucuggacccgggagggggagaagaagaagcugcgcccccgguggcucgacgcccgcguguacgccgacccgauggcccugaaggacuucaaggaguucgcguccggccgcaagagcaucacccuggacauccucaccgagaucgccucccugcccaccuaccugagcucccgcgccaagcucgcccuggacaacaucgucaugcugcacacgaccgagcgcggcgggcgggccuaccagcacgcgcucaacgagcugcccgagagccuggagacccucaugcugguggcccugcucggcgccaugaccgccgggaucuuccuguucuucaugcagggcaaggggaucggcaagcugagcaugggccucaucgcgaucgccguggccuccgggcugcugugggucgccgagauccagccgcaguggaucgccgcgagcaucauccucgaguucuuccugauggugcugcucauccccgagcccgagaagcagcgcacgccccaggacaaccagcugaucuacgugauccugaccauccucaccaucaucggccugaucgccgccaacgagauggggcugaucgagaagaccaagacggacuucggcuucuaccaggucaagaccgagaccaccauccucgacguggaccugcggccggccuccgccuggacgcuguacgcgguggccaccaccauccucacccccaugcugcgccacacgaucgagaacaccagcgccaaccugucccucgccgccaucgcgaaccaggccgccguccugauggggcugggcaagggcuggccccuccaccggauggaccugggggugccccugcucgccaugggcugcuacagccaggugaacccgaccacccugacggccucccuggucaugcuccuggugcacuacgcgaucaucgggcccggccugcaggccaaggccacccgcgaggcccagaagcggaccgcggccggcaucaugaagaaccccaccguggacgggaucacggucaucgaccucgagcccaucagcuacgacccgaaguucgagaagcagcugggccaggugaugcugcucgugcugugcgccgggcagcugcuccugaugcgcaccaccugggccuucugcgagguccugacccucgccacgggccccauccugacccugugggaggggaaccccggccgguucuggaacaccaccaucgcgguguccacggccaacaucuuccgcggcagcuaccucgccggggccggccuggccuucucccugaucaagaacgcgcagacgccccggcgcgggaccggcaccacgggggagacccucggcgagaaguggaagcggcagcugaacagccuggaccgcaaggaguucgaggaguacaagcgguccggcauccucgagguggaccgcaccgaggccaagagcgcccugaaggacggguccaagaccaagcacgccgucagccggggcuccagcaagauccgcuggaucguggagcgggggauggugaagccgaagggcaaggucguggaccuggggugcggccgcggcgggugguccuacuacauggccacccucaagaacgugacggaggucaagggcuacaccaagggcggccccgggcacgaggagcccauccccauggcgaccuacggcuggaaccuggugaagcugcacagcggcguggacgucuucuacaagccgaccgagcaggucgacacgcuccugugcgacaucggggagagcuccagcaaccccaccaucgaggagggccgcacccugcgggugcucaagauggucgagcccuggcuguccagcaagcccgaguucugcaucaaggugcugaacccguacaugcccaccgucaucgaggagcuggagaagcuccagcgcaagcacgggggcaaccuggugcggugcccccugucccgcaacagcacgcacgagauguacuggguguccggcgccagcgggaacaucgucuccagcgugaacaccaccuccaagaugcuccugaaccgguucaccacgcgccaccggaagcccaccuacgagaaggacguggaccugggcgccgggacccgcagcgucuccaccgagacggagaagccggacaugaccaucaucggccggcgccuccagcggcugcaggaggagcacaaggagaccuggcacuacgaccaggagaaccccuaccgcaccugggccuaccacgggagcuacgaggcgcccuccacgggcagcgccuccagcauggugaacggcguggucaagcugcucaccaagccgugggacgugauccccauggugacccagcuggccaugaccgacacgacccccuucgggcagcagcgggucuucaaggagaagguggacacccgcacgccccagccgaagcccggcacgcggaugaucaugaccaccaccgccaacuggcugugggcccuccuggggaagaagaagaacccccgccugugcacgcgggaggaguucaucuccaaggugcgcagcaacgcggccaucggcgccgucuuccaggaggagcagggguggaccagcgccuccgaggccgugaacgacagccgguucugggagcucguggacaaggagcgcgcgcugcaccaggagggcaagugcgaguccugcgucuacaacaugaugggcaagcgggagaagaagcugggggaguucggccgcgccaaggggagccgcgccaucugguacauguggcucggcgcccgguuccuggaguucgaggcccugggguuccucaacgaggaccacugguucggccgcgagaacuccuggagcggcguggagggggagggccugcaccggcugggguacauccucgaggagaucgacaagaaggacggcgaccugauguacgcggacgacaccgccggcugggacacccgcaucacggaggacgaccugcagaacgaggagcucaucaccgagcagauggcgccccaccacaagauccuggccaaggcgaucuucaagcugaccuaccagaacaagguggucaaggugcuccggccgacgccccgcggggccgugauggacaucaucucccggaaggaccagcggggcagcgggcaggucggcaccuacgggcugaacacguucaccaacauggaggugcagcugauccggcagauggaggccgagggcgugaucacccaggacgacaugcagaaccccaagggccucaaggagcgcgucgagaaguggcugcgggagugcgggguggaccgccugaagcggauggccaucuccggcgacgacugcguggucaagccccucgacgagcgcuucgggaccagccugcuguuccucaacgacaugggcaaggugcggaaggacaucccgcagugggagcccuccaagggguggaagaacuggcaggaggugcccuucugcagccaccacuuccacaagaucuucaugaaggacggccgcucccuggucgugcccugccggaaccaggacgagcugaucggccgcgcccggaucagccagggggcgggcuggucccuccgcgagacggccugccuggggaaggccuacgcccagauguggagccugauguacuuccaccgccgggaccuccgccuggccuccauggcgaucugcagcgccgugccgaccgagugguuccccaccagccggaccacgugguccauccacgcccaccaccaguggaugaccaccgaggacaugcugaaggucuggaaccgcguguggaucgaggacaaccccaacaugaccgacaagacgcccauccacagcugggaggacaucccguaccucggcaagcgggaggaccuguggugcgggucccugaucggccucagcucccgcgccaccugggccaagaacauccacaccgcgaucacccaggugcggaaccugaucggcaaggaggaguacgucgacuacaugcccgugaugaagcgcuacagcgcccccuccgagagcgagggggugcuguga

SEQ ID NO: 10442 - RNA, 9867 nt, Artificial Sequence
  derived and/or modified CDS sequence (opt1) from DENV-4__FJ810417__SS-prME
agcaccaucacccugcucugccugauccccacggugauggccuuccaccuguccacccgcgacggcgagccgcucaugaucgucgccaagcacgagcgggggcgcccccugcuguucaagaccaccgagggcaucaacaagugcacgcucaucgcgauggaccugggggagaugugcgaggacaccgugaccuacaagugcccccugcucgugaacaccgagcccgaggacaucgacugcuggugcaaccugacgagcaccugggucauguacggcaccugcacccaguccggggagcggcgccgggagaagcgcagcguggcccugacgccgcacuccggcaugggccucgagacccgggccgagaccuggaugagcuccgagggggccuggaagcacgcccagcgcguggagagcuggauccugcggaaccccggcuucgcgcugcucgccggguucauggccuacaugaucggccagaccgggauccagcgcacggucuucuucgugcugaugaugcugguggcccccuccuacggcaugcggugcgucggcguggggaaccgcgacuucguggagggcgucagcgggggcgcguggguggaccucgugcuggagcacggcgggugcgucaccaccauggcccagggcaagcccacccuggacuucgagcucacgaagaccaccgccaaggagguggcccugcugcggaccuacugcaucgaggccuccaucagcaacaucacgaccgcgacccgcugcccgacccagggggagcccuaccucaaggaggagcaggaccagcaguacaucugccggcgcgacguggucgaccggggcugggggaacggcugcggccuguucgggaagggcgggguggugacgugcgccaaguucuccugcagcggcaagaucaccgggaaccugguccagaucgagaaccucgaguacaccgugguggucaccgugcacaacggcgacacgcacgccgucggcaacgacaccuccaaccacggggugaccgccaccaucacgccccgcagccccuccguggaggucaagcugccggacuacggcgagcugacccucgacugcgagccccggagcgggaucgacuucaacgagaugauccugaugaagaugaagaagaagaccuggcuggugcacaagcagugguuccucgaccugccccugcccuggaccgccggcgcggacaccuccgaggugcacuggaacuacaaggagcgcauggucacguucaaggugccgcacgccaagcggcaggacgugaccguccucgggagccaggagggcgccaugcacagcgcccuggccggcgcgaccgagguggacuccggggacggcaaccacauguucgccgggcaccugaagugcaaggugcgcauggagaagcuccgcaucaagggcaugagcuacaccaugugcuccggcaaguucagcaucgacaaggagauggccgagacgcagcacgggaccaccgucgugaaggugaaguacgagggcgccggggcccccugcaagguccccaucgagauccgggacgugaacaaggagaagguggucggccgcgugaucuccagcaucccccuggcggagaacaccaacuccgugacgaacaucgagcuggagccgcccuucggggacagcuacaucgucaucggcgugggcaacuccgcccucacccugcacugguuccggaaggggagcuccaucggcaagauguucgagagcaccuaccgcggggccaagcggauggccauccugggcgagaccgcgugggacuucggguccgugggcggccucuucacgagccuggggaaggccguccaccagguguucggcuccguguacaccaccauguucgggggcgucagcuggaugauccgcauccugaucggguuccucgugcuguggaucggcaccaacucccggaacacgagcauggccaugaccugcaucgccgugggcgggaucacccuguuccugggcuucaccguccaggccgacauggggugcgugguguccuggagcggccgcgagcucaagugcgggagcggcaucuucgucguggacaacgugcacacguggaccgagcaguacaaguuccagcccgagucccccgcgcggcuggccagcgccauccugaacgcccacaaggacggcgucugcgggauccgcuccaccacccggcucgagaacgugauguggaagcagaucacgaacgagcugaacuacgugcugugggagggcgggcacgaccucaccgucguggccggcgacgugaagggcguccugaccaaggggaagcgcgcgcugaccccgcccgugagcgaccucaaguacuccuggaagacguggggcaaggccaagaucuucacccccgaggcccggaacagcaccuuccugaucgacgggcccgacaccuccgagugcccgaacgagcgccgggccuggaacagccuggagguggaggacuacggcuucgggauguucacgaccaacaucuggaugaaguuccgcgagggcuccagcgaggucugcgaccaccggcucauguccgccgcgaucaaggaccagaaggccgugcacgccgacaugggcuacuggaucgagagcuccaagaaccagaccuggcagaucgagaaggccagccugaucgaggugaagaccugccuguggcccaagacgcacacccucugguccaacgggguccuggagagccagaugcugauccccaaguccuacgcgggcccguucagccagcacaacuaccgccagggguacgccacccagaccgugggccccuggcaccucgggaagcuggagaucgacuucggcgagugccccggcaccacggugaccauccaggaggacugcgaccaccgggggcccagccugcgcaccaccacggccuccggcaagcucgucacccaguggugcugccgcagcugcaccaugccgccccugcgguuccugggggaggacggcugcugguacgggauggagauccgcccccucaacgagaaggaggagaacauggugaagucccaggucaccgccggccagggcacgagcgagaccuucuccauggggcugcugugccucacccuguucguggaggagugccugcggcgccgggugacccgcaagcacaugauccucgucguggugaucacgcugugcgccaucauccugggcgggcucaccuggauggaccugcugcgggcgcucaucaugcugggcgacaccaugagcggccgcaucgggggccagauccaccuggccaucauggccgucuucaagaugucccccggguacgugcucggcguguuccugcggaagcugaccagccgcgagacggcccucauggucaucgggauggccaugaccaccgugcuguccaucccgcacgaccugauggagcucaucgacggcaucagccugggccugauccuccugaagaucgugacccaguucgacaacacgcaggucgggacccuggcgcucucccugaccuucauccggagcaccaugccccuggugauggccuggcgcacgaucauggccgugcucuucgucgugacccugaucccccugugccggaccuccugccuccagaagcagagccacuggguggagaucaccgcccugauccugggcgcccaggcgcuccccgucuaccugaugacgcugaugaagggggccucccgccggagcuggccgcucaacgagggcaucauggccguggggcuggugucccugcucggcagcgcccugcugaagaacgacgucccccucgcgggccccaugguggccgggggccugcugcucgccgccuacgugauguccgggagcagcgccgaccugucccuggagaaggcggccaacguccagugggacgagauggccgacaucaccggcagcucccccaucaucgaggugaagcaggacgaggacgggagcuucuccauccgcgacguggaggagaccaacaugaucacccuccuggucaagcuggcccucaucacggugagcggccuguacccgcuggccauccccgugaccaugacccucugguacauguggcaggucaagacccagcgguccggcgcgcugugggacgugcccagccccgccgccacgcagaaggccgcccuguccgaggggguguaccgcaucaugcagcggggccucuucgggaagacccaggucggcguggggauccacauggagggcguguuccacaccauguggcacgucacccgcggcagcgugaucugccacgagaccgggcggcuggagccguccugggcggacgugcgcaacgacaugaucagcuacggcgggggcuggcgccugggcgacaagugggacaaggaggaggacguccaggugcucgccaucgagcccgggaagaaccccaagcacgugcagacgaagcccggccuguucaagacccugaccggggagaucggcgccgucacccucgacuucaagccggggacguccggcagccccaucaucaaccggaagggcaaggugaucgggcuguacggcaacgggguggucaccaaguccggcgacuacgugagcgccaucacccaggccgagcgcaucggggagcccgacuacgagguggacgaggacaucuuccggaagaagcgccugaccaucauggaccuccacccgggcgcgggcaagacgaagcggauccugcccuccaucguccgcgaggcccugaagcggcgccugcggacccucauccuggcccccacccgcgugguggccgcggagauggaggaggcccugcgggggcuccccauccgcuaccagaccccggccgucaagagcgagcacacgggccgggagaucguggaccugaugugccacgccaccuucaccacccgccugcucuccagcacgcggguccccaacuacaaccugaucgugauggacgaggcccacuucaccgaccccagcuccguggcggcccgcggguacaucagcacccgggucgagaugggcgaggccgccgccaucuucaugaccgcgacgcccccgggggccaccgaccccuucccccaguccaacagccccaucgaggacaucgagcgcgagaucccggagcgguccuggaacaccggcuucgacuggaucaccgacuaccagggcaagacggugugguucgugcccagcaucaaggccgggaacgacaucgccaacugccugcgcaaguccggcaagaaggucauccagcucagccgcaagaccuucgacaccgaguaccccaagaccaagcugacggacugggacuucguggugaccaccgacaucuccgagaugggggccaacuuccgggcgggccgcgucaucgacccccggcgcugccugaagccggugauccucaccgacgggcccgagcgggugauccuggccggccccauccccgucacgccggccagcgccgcgcagcgccggggccgcaucgggcggaaccccgcccaggaggacgaccaguacguguucuccggcgacccccugaagaacgacgaggaccacgcccacuggaccgaggccaagaugcuccuggacaacaucuacacccccgaggggaucaucccgacccuguucggccccgagcgcgagaagacgcaggccaucgacggcgaguuccggcuccgcggggagcagcggaagaccuucguggagcugaugcgccggggcgaccugcccgucuggcucagcuacaagguggcguccgccgggaucagcuacaaggaccgcgaguggugcuucaccggcgagcggaacaaccagauccuggaggagaacauggagguggagaucuggacccgcgagggggagaagaagaagcugcggccccgcuggcucgacgcccgggucuacgccgacccgauggcccugaaggacuucaaggaguucgcguccggccgcaagagcaucacgcuggacauccucaccgagaucgccucccugcccaccuaccugagcucccgcgccaagcucgcccuggacaacaucgugaugcugcacaccaccgagcggggcgggcgcgccuaccagcacgcgcucaacgagcugcccgagagccuggagacgcucaugcugguggcccugcucggcgccaugaccgccgggaucuuccuguucuucaugcagggcaaggggaucggcaagcugagcaugggccucaucgcgaucgccgucgccuccgggcugcuguggguggccgagauccagccgcaguggaucgccgcgagcaucauccucgaguucuuccugauggugcugcucauccccgagcccgagaagcagcggaccccccaggacaaccagcugaucuacgucauccugaccauccucacgaucaucggccugaucgccgccaacgagauggggcugaucgagaagaccaagaccgacuucggcuucuaccaggugaagaccgagacgaccauccucgacguggaccugcgcccggccuccgccuggacccuguacgcggucgccaccacgauccucacccccaugcugcggcacaccaucgagaacaccagcgccaaccugucccucgccgccaucgcgaaccaggccgccgugcugauggggcugggcaagggcuggccccuccaccgcauggaccugggggugccccugcucgccaugggcugcuacagccaggucaacccgacgacccugaccgccucccuggugaugcuccuggugcacuacgcgaucaucgggcccggccugcaggccaaggccacccgggaggcccagaagcgcacggcggccggcaucaugaagaaccccaccgucgacgggaucaccgugaucgaccucgagcccaucagcuacgacccgaaguucgagaagcagcugggccaggugaugcugcucguccugugcgccgggcagcugcuccugaugcggaccacgugggccuucugcgaggugcugacccucgccaccggccccauccugacccugugggaggggaaccccggccgcuucuggaacacgaccaucgcgguguccaccgccaacaucuuccggggcagcuaccucgccggggccggccuggccuucucccugaucaagaacgcgcagaccccccgccgggggacgggcaccaccggggagacccucggcgagaaguggaagcgccagcugaacagccuggaccggaaggaguucgaggaguacaagcgcuccggcauccucgaggucgaccggacggaggccaagagcgcccugaaggacggguccaagaccaagcacgccgugagccgcggcuccagcaagauccgguggaucguggagcgcgggauggucaagccgaagggcaaggugguggaccuggggugcggccgcggcgggugguccuacuacauggccacccucaagaacgucaccgaggugaagggcuacaccaaggggggccccgggcacgaggagcccauccccauggcgacguacggcuggaaccuggugaagcugcacagcggcgucgacguguucuacaagccgaccgagcagguggacacccuccugugcgacaucggggagagcuccagcaaccccaccaucgaggagggccggacgcugcgcguccucaagaugguggagcccuggcuguccagcaagcccgaguucugcaucaagguccugaacccguacaugcccaccgugaucgaggagcuggagaagcuccagcggaagcacgggggcaaccuggugcgcugcccccugucccggaacagcacccacgagauguacugggucuccggcgccagcgggaacaucguguccagcgugaacaccacguccaagaugcuccugaaccgcuucaccacccggcaccgcaagcccaccuacgagaaggacgucgaccugggcgccgggacgcggagcguguccaccgagaccgagaagccggacaugaccaucaucggccgccggcuccagcgccugcaggaggagcacaaggagacguggcacuacgaccaggagaaccccuaccggaccugggccuaccacgggagcuacgaggcgcccuccaccggcagcgccuccagcauggugaacggcgucgugaagcugcucaccaagccgugggacgugauccccauggucacgcagcuggccaugaccgacaccacccccuucgggcagcagcgcguguucaaggagaagguggacacgcggaccccccagccgaagcccggcacccgcaugaucaugaccacgaccgccaacuggcugugggcccuccuggggaagaagaagaacccccggcugugcacccgcgaggaguucaucuccaagguccggagcaacgcggccaucggcgccguguuccaggaggagcagggguggaccagcgccuccgaggccgugaacgacagccgcuucugggagcucgucgacaaggagcgggcgcugcaccaggagggcaagugcgaguccugcguguacaacaugaugggcaagcgcgagaagaagcugggggaguucggccgcgccaaggggagccgggccaucugguacauguggcucggcgcccgcuuccuggaguucgaggcccugggguuccucaacgaggaccacugguucggccgggagaacuccuggagcggcguggagggggagggccugcaccgccugggguacauccucgaggagaucgacaagaaggacggcgaccugauguacgcggacgacacggccggcugggacacccggaucaccgaggacgaccugcagaacgaggagcucaucaccgagcagauggccccccaccacaagauccuggccaaggcgaucuucaagcugacguaccagaacaaggucgugaaggugcuccgcccgaccccccggggggccgucauggacaucaucucccgcaaggaccagcggggcagcgggcaggugggcaccuacgggcugaacaccuucaccaacauggaggugcagcugauccgccagauggaggccgagggcgucaucacgcaggacgacaugcagaaccccaagggccucaaggagcggguggagaaguggcugcgcgagugcgggguggaccggcugaagcgcauggccaucuccggcgacgacugcgucgugaagccccucgacgagcgguucgggaccagccugcuguuccucaacgacaugggcaaggugcgcaaggacaucccgcagugggagcccuccaagggguggaagaacuggcaggagguccccuucugcagccaccacuuccacaagaucuucaugaaggacggccggucccugguggugcccugccgcaaccaggacgagcugaucggccgggcccgcaucagccagggggcgggcuggucccuccgcgagaccgccugccuggggaaggccuacgcccagauguggagccugauguacuuccaccggcgcgaccuccggcuggccuccauggcgaucugcagcgccgucccgaccgagugguuccccacgagccgcaccaccugguccauccacgcccaccaccaguggaugaccacggaggacaugcugaagguguggaaccggguguggaucgaggacaaccccaacaugaccgacaagacccccauccacagcugggaggacaucccguaccucggcaagcgcgaggaccuguggugcgggucccugaucggccucagcucccgggccaccugggccaagaacauccacacggcgaucacccagguccgcaaccugaucggcaaggaggaguacguggacuacaugcccgugaugaagcgguacagcgcccccuccgagagcgaggggguccuguga

SEQ ID NO: 10443 - RNA, 9867 nt, Artificial Sequence
  derived and/or modified CDS sequence (opt1) from DENV-4__FJ850057__SS-prME
agcaccaucacccugcucugccugauccccacggccauggccuuccaccuguccacccgcgacggcgagccgcucaugaucguggcgaagcacgagcgggggcgcccccugcuguucaagaccaccgagggcaucaacaagugcacgcucaucgccauggaccugggggagaugugcgaggacaccgucaccuacaagugcccccugcucgugaacaccgagcccgaggacaucgacugcuggugcaaccugacgagcaccugggugauguacggcaccugcacccaguccggggagcggcgccgggagaagcgcagcgucgcccugacgccgcacuccggcaugggccucgagacccgggccgagaccuggaugagcuccgagggggccuggaagcacgcgcagcgcguggagagcuggauccugcggaaccccggcuucgcccugcucgccggguucauggccuacaugaucggccagaccgggauccagcgcacgguguucuucguccugaugaugcugguggcgcccuccuacggcaugcggugcgugggcgucgggaaccgcgacuucguggagggcgugagcgggggcgccugggucgaccucgugcuggagcacggcgggugcgugaccaccauggcccagggcaagcccacccuggacuucgagcucacgaagaccaccgccaaggaggucgcccugcugcggaccuacugcaucgaggcguccaucagcaacaucacgaccgccacccgcugcccgacccagggggagcccuaccucaaggaggagcaggaccagcaguacaucugccggcgcgacgugguggaccggggcugggggaacggcugcggccuguucgggaagggcggggucgugacgugcgccaaguucuccugcagcggcaagaucaccgggaaccuggugcagaucgagaaccucgaguacaccgucguggugaccguccacaacggcgacacgcacgccgugggcaacgacaccuccaaccacggggucaccgccaccaucacgccccgcagccccuccguggaggugaagcugccggacuacggcgagcugacccucgacugcgagccccggagcgggaucgacuucaacgagaugauccugaugaagaugaagaagaagaccuggcugguccacaagcagugguuccucgaccugccccugcccuggaccgcgggcgccgacaccuccgaggugcacuggaacuacaaggagcgcauggugacguucaaggucccgcacgccaagcggcaggacgugaccgugcucgggagccaggagggcgccaugcacagcgcccuggcgggcgccaccgaggucgacuccggggacggcaaccacauguucgccgggcaccugaagugcaaggugcgcauggagaagcuccgcaucaagggcaugagcuacaccaugugcuccggcaaguucagcaucgacaaggagauggccgagacgcagcacgggaccaccguggucaaggugaaguacgagggcgccggggcgcccugcaaggugcccaucgagauccgggacgucaacaaggagaagguggugggccgcgucaucuccagcaccccccuggccgagaacacgaacuccgugaccaacaucgagcuggagccgcccuucggggacagcuacaucgugaucggcgucggcaacuccgcccucacccugcacugguuccggaaggggagcuccaucggcaagauguucgagagcaccuaccgcggggccaagcggauggcgauccugggcgagacggccugggacuucggguccgugggcggccucuucaccagccuggggaaggccgugcaccaggucuucggcuccguguacaccaccauguucgggggcgugagcuggaugauccgcauccugaucggguuccucguccuguggaucggcacgaacucccggaacaccagcauggccaugaccugcaucgccgugggcgggaucacccuguuccugggcuucacggugcaggcggacauggggugcgucguguccuggagcggccgcgagcucaagugcgggagcggcaucuucguggucgacaacgugcacaccuggaccgagcaguacaaguuccagcccgagucccccgcccggcuggccagcgccauccugaacgcccacaaggacggcgugugcgggauccgcuccaccacgcggcucgagaacgucauguggaagcagaucaccaacgagcugaacuacgugcugugggagggcgggcacgaccucaccguggucgcgggcgacgugaagggcgugcugaccaaggggaagcgcgcccugacgccgcccgucagcgaccucaaguacuccuggaagaccuggggcaaggccaagaucuucacccccgaggcccggaacagcaccuuccugaucgacgggcccgacacguccgagugcccgaacgagcgccgggccuggaacagccuggagguggaggacuacggcuucgggauguucaccaccaacaucuggaugaaguuccgcgagggcuccagcgaggugugcgaccaccggcucauguccgcggccaucaaggaccagaaggccguccacgccgacaugggcuacuggaucgagagcuccaagaaccagaccuggcagaucgagaaggcgagccugaucgaggugaagacgugccuguggcccaagacccacacccucugguccaacggggugcuggagagccagaugcugauccccaaguccuacgccggcccguucagccagcacaacuaccgccagggguacgccacccagaccgucggccccuggcaccucgggaagcuggagaucgacuucggcgagugccccggcacgaccgugaccauccaggaggacugcgaccaccgggggcccagccugcgcaccacgaccgccuccggcaagcucgugacccaguggugcugccgcagcugcaccaugccgccccugcgguuccugggggaggacggcugcugguacgggauggagauccgcccccucaacgagaaggaggagaacauggucaagucccaggugacggccggccagggcaccagcgagaccuucuccauggggcugcugugccucacccuguucgucgaggagugccugcggcgccgggugacgcgcaagcacaugauccucguggucgugaucacccugugcgcgaucauccugggcgggcucaccuggauggaccugcugcgggcccucaucaugcugggcgacaccaugagcggccgcaucgggggccagauccaccuggccaucauggccguguucaagaugucccccggguacguccucggcguguuccugcggaagcugacgagccgcgagaccgcccucauggugaucgggauggcgaugaccaccguccuguccaucccgcacgaccugauggagcucaucgacggcaucagccugggccugauccuccugaagaucgugacgcaguucgacaacacccagguggggacccuggcccucucccugaccuucauccggagcacgaugccccuggucauggccuggcgcaccaucauggccgugcucuucguggucacccugaucccccugugccggaccuccugccuccagaagcagagccacuggguggagaucacggcccugauccugggcgcgcaggcccuccccguguaccugaugacccugaugaagggggccucccgccggagcuggccgcucaacgagggcaucauggccgucgggcuggugucccugcucggcagcgcgcugcugaagaacgacgugccccucgccggccccauggucgccgggggccugcugcucgccgccuacgugauguccgggagcagcgcggaccugucccuggagaaggccgccaacgugcagugggacgagauggccgacaucaccggcagcucccccaucaucgaggucaagcaggacgaggacgggagcuucuccauccgcgacguggaggagaccaacaugaucacgcuccuggugaagcuggcccucaucaccgucagcggccuguacccgcuggcgauccccgugaccaugacccucugguacauguggcaggugaagacgcagcgguccggcgcccugugggacguccccagccccgccgccacccagaaggccgcgcuguccgaggggguguaccgcaucaugcagcggggccucuucgggaagacccaggugggcgucgggauccacauggagggcguguuccacaccauguggcacgugacccgcggcagcgucaucugccacgagacggggcggcuggagccguccugggccgacgugcgcaacgacaugaucagcuacggcgggggcuggcgccugggcgacaagugggacaaggaggaggacgugcagguccucgccaucgagcccgggaagaaccccaagcacgugcagaccaagcccggccuguucaagacccugaccggggagaucggcgccgugacgcucgacuucaagccggggaccuccggcagccccaucaucaaccggaagggcaaggucaucgggcuguacggcaacgggguggugaccaaguccggcgacuacgucagcgccaucacccaggcggagcgcaucggggagcccgacuacgagguggacgaggacaucuuccggaagaagcgccugacgaucauggaccuccacccgggcgccggcaagaccaagcggauccugcccuccaucgugcgcgaggcccugaagcggcgccugcggacccucauccuggcccccacccgcgucguggcggccgagauggaggaggcccugcgggggcuccccauccgcuaccagacgccggccgugaagagcgagcacaccggccgggagaucgucgaccugaugugccacgccaccuucaccacgcgccugcucuccagcacccgggugcccaacuacaaccugaucgucauggacgaggcgcacuucaccgaccccagcuccguggccgcccgcggguacaucagcacccggguggagaugggcgaggccgccgcgaucuucaugacggccacccccccgggggccaccgaccccuucccccaguccaacagccccaucgaggacaucgagcgcgagaucccggagcgguccuggaacaccggcuucgacuggaucacggacuaccagggcaagaccgucugguucgugcccagcaucaaggccgggaacgacaucgccaacugccugcgcaaguccggcaagaaggugauccagcucagccgcaagaccuucgacaccgaguaccccaagacgaagcugaccgacugggacuucgucgugaccaccgacaucuccgagaugggggcgaacuuccgggccggccgcgugaucgacccccggcgcugccugaagccggucauccucacggacgggcccgagcgggugauccuggccggccccauccccgugaccccggccagcgcggcccagcgccggggccgcaucgggcggaaccccgcccaggaggacgaccaguacgucuucuccggcgacccccugaagaacgacgaggaccacgcccacuggaccgaggccaagaugcuccuggacaacaucuacacccccgaggggaucaucccgacgcuguucggccccgagcgcgagaagacccaggcgaucgacggcgaguuccggcuccgcggggagcagcggaagaccuucguggagcugaugcgccggggcgaccugcccguguggcucagcuacaaggucgccuccgccgggaucagcuacaaggaccgcgaguggugcuucaccggcgagcggaacaaccagauccuggaggagaacauggagguggagaucuggacgcgcgagggggagaagaagaagcugcggccccgcuggcucgacgcccggguguacgccgacccgauggcgcugaaggacuucaaggaguucgccuccggccgcaagagcaucacccuggacauccucaccgagaucgccucccugcccaccuaccugagcucccgcgccaagcucgcccuggacaacaucgucaugcugcacaccacggagcggggcgggcgcgcguaccagcacgcccucaacgagcugcccgagagccuggagacccucaugcugguggcccugcucggcgccaugaccgcggggaucuuccuguucuucaugcagggcaaggggaucggcaagcugagcaugggccucaucgccaucgccguggccuccgggcugcugugggucgccgagauccagccgcaguggaucgcggccagcaucauccucgaguucuuccugauggugcugcucauccccgagcccgagaagcagcggaccccccaggacaaccagcugaucuacgugauccugacgauccucaccaucaucggccugaucgccgccaacgagauggggcugaucgagaagaccaagaccgacuucggcuucuaccaggucaagacggagaccaccauccucgacguggaccugcgcccggccuccgcguggacccuguacgccguggccacgaccauccucacccccaugcugcggcacaccaucgagaacacgagcgccaaccugucccucgccgcgaucgccaaccaggccgccguccugauggggcugggcaagggcuggccccuccaccgcauggaccugggggugccccugcucgccaugggcugcuacagccaggugaacccgaccacccugaccgcgucccuggucaugcuccuggugcacuacgccaucaucgggcccggccugcaggccaaggccacgcgggaggcgcagaagcgcaccgccgccggcaucaugaagaaccccaccguggacgggaucaccgucaucgaccucgagcccaucagcuacgacccgaaguucgagaagcagcugggccaggugaugcugcucgugcugugcgccgggcagcugcuccugaugcggacgaccugggccuucugcgagguccugacccucgcgaccggccccacgcugacccugugggaggggaaccccggccgcuucuggaacaccaccaucgccguguccacggccaacaucuuccggggcagcuaccucgccggggccggccuggcguucucccugaucaagaacgcccagaccccccgccgggggaccggcaccacgggggagacccucggcgagaaguggaagcgccagcugaacagccuggaccggaaggaguucgaggaguacaagcgcuccggcauccucgagguggaccggaccgaggccaagagcgcccugaaggacggguccaagaccaagcacgccgucagccgcggcuccagcaagauccgguggaucguggagcgcgggauggugaagccgaagggcaaggucguggaccuggggugcggccgcggcgggugguccuacuacauggcgacccucaagaacgugacggaggucaagggcuacaccaaggggggccccgggcacgaggagcccauccccauggccaccuacggcuggaaccuggugaagcugcacagcggcguggacgucuucuacaagccgaccgagcagguggacacgcuccugugcgacaucggggagagcuccagcaaccccaccaucgaggagggccggacccugcgcgugcucaagauggucgagcccuggcuguccagcaagcccgaguucugcaucaaggugcugaacccguacaugcccaccgucaucgaggagcuggagaagcuccagcggaagcacgggggcaaccuggugcgcugcccccugucccggaacagcacgcacgagauguacuggguguccggcgccagcgggaacaucgucuccagcgugaacaccaccuccaagaugcuccugaaccgcuucaccacgcggcaccgcaagcccaccuacgagaaggacguggaccugggcgccgggacccggagcgucuccaccgagacggagaagccggacaugaccaucaucggccgccggcuccagcgccugcaggaggagcacaaggagaccuggcacuacgaccaggagaaccccuaccggaccugggcguaccacgggagcuacgaggcccccuccacgggcagcgccuccagcauggugaacggcguggucaagcugcucaccaagccgugggacgugauccccauggugacccagcuggccaugaccgacacgacccccuucgggcagcagcgcgucuucaaggagaagguggacacccggaccccccagccgaagcccggcacgcgcaugaucaugaccaccaccgccaacuggcugugggcgcuccuggggaagaagaagaacccccggcugugcacgcgcgaggaguucaucuccaaggugcggagcaacgccgccaucggcgccgucuuccaggaggagcagggguggaccagcgccuccgaggcggugaacgacagccgcuucugggagcucguggacaaggagcgggcccugcaccaggagggcaagugcgaguccugcgucuacaacaugaugggcaagcgcgagaagaagcugggggaguucggccgcgccaaggggagccgggccaucugguacauguggcucggcgcccgcuuccuggaguucgaggcgcugggguuccucaacgaggaccacugguucggccgggagaacuccuggagcggcguggagggggagggccugcaccgccugggguacauccucgaggagaucgacaagaaggacggcgaccugauguacgccgacgacaccgccggcugggacacccggaucacggaggacgaccugcagaacgaggagcucaucaccgagcagauggccccccaccacaagauccuggcgaaggccaucuucaagcugaccuaccagaacaagguggucaaggugcuccgcccgaccccccggggggccgugauggacaucaucucccgcaaggaccagcggggcagcgggcaggucggcaccuacgggcugaacacguucaccaacauggaggugcagcugauccgccagauggaggccgagggcgugaucacccaggacgacaugcagaaccccaagggccucaaggagcgggucgagaaguggcugcgcgagugcgggguggaccggcugaagcgcauggccaucuccggcgacgacugcguggucaagccccucgacgagcgguucgggaccagccugcuguuccucaacgacaugggcaaggugcgcaaggacaucccgcagugggagcccuccaagggguggaagaacuggcaggaggugcccuucugcagccaccacuuccacaagaucuucaugaaggacggccggucccuggucgugcccugccgcaaccaggacgagcugaucggccgggcgcgcaucagccagggggccggcuggucccuccgcgagacggccugccuggggaaggccuacgcccagauguggagccugauguacuuccaccggcgcgaccuccggcuggcguccauggccaucugcagcgccgugccgaccgagugguuccccaccagccgcaccacgugguccauccacgcccaccaccaguggaugaccaccgaggacaugcugaaggucuggaaccggguguggaucgaggacaaccccaacaugaccgacaagacgcccauccacagcugggaggacaucccguaccucggcaagcgcgaggaccuguggugcgggucccugaucggccucagcucccgggccaccugggcgaagaacauccacaccgccaucacccaggugcgcaaccugaucggcaaggaggaguacgucgacuacaugcccgugaugaagcgguacagcgcccccuccgagagcgagggggugcuguga

SEQ ID NO: 10444 - RNA, 9867 nt, Artificial Sequence
  derived and/or modified CDS sequence (opt1) from DENV-4__GQ199881__SS-prME
agcaccaucacccugcucugccugauccccacggugauggccuuccaccuguccacccgcgacggcgagccgcucaugaucgucgccaagcacgagcgggggcgcccccugcuguucaagaccaccgagggcaucaacaagugcacgcucaucgcgauggaccugggggagaugugcgaggacaccgugaccuacaagugcccccugcucgugaacaccgagcccgaggacaucgacugcuggugcaaccugacgagcaccugggucauguacggcaccugcacccaguccggggagcggcgccgggagaagcgcagcguggcccugacgccgcacuccggcaugggccucgagacccgggccgagaccuggaugagcuccgagggggccuggaagcacgcccagcgcguggagagcuggauccugcggaaccccggcuucgcgcugcucgccggguucauggccuacaugaucggccagacccgcauccagcggacggucuucuucgugcugaugaugcugguggcccccuccuacgggaugcgcugcgucggcgugggcaaccgggacuucguggagggggucagcggcggggcguggguggaccucgugcuggagcacggcggcugcgucaccaccauggcccaggggaagcccacccuggacuucgagcucacgaagaccaccgccaaggagguggcccugcugcgcaccuacugcaucgaggccuccaucagcaacaucacgaccgcgacccggugcccgacccagggcgagcccuaccucaaggaggagcaggaccagcaguacaucugccgccgggacguggucgaccgcggguggggcaacgggugcggccuguucggcaaggggggcguggugacgugcgccaaguucuccugcagcgggaagaucaccggcaaccugguccagaucgagaaccucgaguacaccgugguggucaccgugcacaacggggacacgcacgccgucggcaacgacaccuccaaccacggcgugaccgccaccaucacgccccggagccccuccguggaggucaagcugccggacuacggggagcugacccucgacugcgagccccgcagcggcaucgacuucaacgagaugauccugaugaagaugaagaagaagaccuggcuggugcacaagcagugguuccucgaccugccccugcccuggaccgccggggcggacaccuccgaggugcacuggaacuacaaggagcggauggucacguucaaggugccgcacgccaagcgccaggacgugaccguccucggcagccaggagggggccaugcacagcgcccuggccggcgcgaccgagguggacuccggcgacgggaaccacauguucgccggccaccugaagugcaaggugcgcauggagaagcuccggaucaaggggaugagcuacaccaugugcuccggcaaguucagcaucgacaaggagauggccgagacgcagcacggcaccaccgucgugaaggugaaguacgagggggccggcgcccccugcaagguccccaucgagauccgcgacgugaacaaggagaagguggucgggcgggugaucuccagcaccccccuggcggagaacacgaacuccgugaccaacaucgagcuggagccgcccuucggcgacagcuacaucgucaucggggugggcaacuccgcccucacccugcacugguuccgcaagggcagcuccaucgggaagauguucgagagcaccuaccggggcgccaagcgcauggccauccugggggagacggcgugggacuucggcuccguggggggccucuucaccagccugggcaaggccguccaccagguguucggguccguguacaccaccauguucggcggggucagcuggaugauccggauccugaucggcuuccucgugcuguggaucgggacgaacucccgcaacaccagcauggccaugaccugcaucgccgugggcggcaucacccuguuccugggguucacgguccaggccgacaugggcugcgugguguccuggagcgggcgggagcucaagugcggcagcgggaucuucgucguggacaacgugcacaccuggaccgagcaguacaaguuccagcccgagucccccgcgcgccuggccagcgccauccugaacgcccacaaggacggcgucugcggcauccgguccaccacgcgccucgagaacgugauguggaagcagaucaccaacgagcugaacuacgugcugugggaggggggccacgaccucaccgucguggccggggacgugaagggcguccugaccaagggcaagcgggcgcugacgccgcccgugagcgaccucaaguacuccuggaagaccugggggaaggccaagaucuucacccccgaggcccgcaacagcaccuuccugaucgacggccccgacacguccgagugcccgaacgagcggcgcgccuggaacagccuggagguggaggacuacggguucggcauguucaccaccaacaucuggaugaaguuccgggagggguccagcgaggucugcgaccaccgccucauguccgccgcgaucaaggaccagaaggccgugcacgccgacaugggcuacuggaucgagagcuccaagaaccagaccuggcagaucgagaaggccagccugaucgaggugaagacgugccuguggcccaagacccacacccucugguccaacggcguccuggagagccagaugcugauccccaaguccuacgcggggccguucagccagcacaacuaccggcagggcuacgccacccagaccguggggcccuggcaccucggcaagcuggagaucgacuucggggagugccccggcacgaccgugaccauccaggaggacugcgaccaccgcggccccagccugcgcaccacgaccgccuccgggaagcucgucacccaguggugcugccggagcugcaccaugccgccccugcgcuuccugggcgaggacgggugcugguacggcauggagauccggccccucuccgagaaggaggagaacauggugaagagccaggucgccgccgggcagggcacguccgagaccuucuucaugggccugcugugccucacccuguucguggaggagugccugcgccggcgcgugacccggaagcacaugauccucgcggucgugaucacgcugugcgccaucauccuggggggccucaccuggauggaccugcugcgcgcccucaucaugcugggggacaccaugagcggccggaucggcgggcagacccaccuggccaucauggccguguucaagaugucccccggcuacguccucgggguguuccugcgcaagcugacgagccgggagaccgcgcucauggugaucggcauggccaugaccaccacgcuguccaucccgcacgaccugauggagcucaucgacgggaucagccugggccugauccuccugaagaucgucacccaguucgacaacacccaggugggcacccuggcccucucccugacguucauccgcagcaccaugucccuggugauggccuggcggaccaucauggccguccucuucguggugacccugaucccccugugccgcacgagcugccuccagaagcagucccacugggucgagaucaccgcgcugauccugggggcccaggcccuccccguguaccugaugacccugaugaagggcgccagccggcgcuccuggccccucaacgaggggaugauggcggugggccuggucagccugcucggguccgcccugcugaagaacgacgugccgcucgccggccccaugguggccggcgggcugcugcucgccgcguacgucaugagcggcagcuccgccgaccugagccuggagaaggccgccaacgugcagugggacgagauggccgacaucaccggguccagccccaucaucgaggugaagcaggacgaggacggcuccuucagcauccgggacgucgaggagacgaacaugaucacccuccuggugaagcuggcgcucaucaccguguccgggcuguacccccuggccaucccggucaccaugacgcucugguacauguggcaggugaagacccagcgcagcggcgcccugugggacgugcccucccccgccgccacccagaaggcggcccugagcgagggcgucuaccggaucaugcagcgcgggcucuucggcaagacccaggugggggugggcauccacauggagggggucuuccacaccauguggcacgugacgcggggcuccgugaucugccacgagaccggccgccuggagcccagcugggccgacguccgcaacgacaugaucuccuacgggggcggguggcggcugggcgacaagugggacaaggaggaggacgugcaggugcucgccaucgagccgggcaagaaccccaagcacguccagaccaagcccgggcuguucaagacccugacgggcgagaucggggccgugacccucgacuucaagcccggcagcuccgggagcccgaucaucaaccgcaagggcaaggugaucggccuguacgggaacggcgucgugaccaaguccggggacuacgugagcgcgaucacccaggccgagcggaucggcgagcccgacuacgaggucgacgaggacaucuuccgcaagaagcggcugacgaucauggaccuccaccccggggccggcaagaccaagcgcauccugccguccaucgugcgggaggcccugaagcgccggcugcgcacccucauccuggcgcccacccggguggucgccgccgagauggaggaggcccugcgcggccuccccauccgguaccagacgcccgccgugaagagcgagcacaccgggcgcgagaucguggaccugaugugccacgcgaccuucaccacgcggcugcucagcuccacccgcgucccgaacuacaaccugaucgugauggacgaggcccacuucaccgaccccagcuccgucgccgcccggggcuacaucagcacccgcguggagaugggggaggccgcggccaucuucaugacggccaccccccccggcgccaccgacccguucccccaguccaacagccccaucgaggacaucgagcgggagauccccgagcgcuccuggaacaccggguucgacuggaucacggacuaccagggcaagaccgugugguucgucccgagcaucaaggccggcaacgacaucgcgaacugccugcgcaaguccgggaagaaggugauccagcucagccggaagaccuucgacaccgaguaccccaagacgaagcugaccgacugggacuucguggucaccaccgacaucuccgagaugggcgccaacuuccgcgccgggcgggugaucgacccccgccggugccugaagcccgugauccucacggacggcccggagcgcgucauccuggccgggcccauccccgugacccccgcgagcgccgcccagcggcgcggccggaucggccgcaacccggcccaggaggacgaccaguacguguucuccggggacccccugaagaacgacgaggaccacgcccacuggaccgaggcgaagaugcuccuggacaacaucuacacccccgagggcaucauccccacgcuguucgggccggagcgggagaagacccaggccaucgacggcgaguuccgccuccggggcgagcagcgcaagaccuucgucgagcugaugcggcgcggggaccugcccguguggcucagcuacaagguggccuccgccggcaucagcuacaaggaccgggaguggugcuucaccggggagcgcaacaaccagauccuggaggagaacauggaggucgagaucuggacgcgggagggcgagaagaagaagcugcgcccccgguggcucgacgcccgcguguacgcggaccccauggcccugaaggacuucaaggaguucgccuccgggcgcaagagcaucacccuggacauccucaccgagaucgccucccugccgaccuaccugagcagccgggccaagcucgcgcuggacaacaucgugaugcugcacaccacggagcgcggcggccgggccuaccagcacgcccucaacgagcugcccgagucccuggagacccucaugcuggucgcccugcucggggcgaugaccgccggcaucuuccuguucuucaugcaggggaagggcaucgggaagcugagcaugggccucaucaccaucgccguggccuccggccugcuguggguggccgagauccagccccaguggaucgcggccagcaucauccucgaguucuuccugaugguccugcucaucccggagcccgagaagcagcgcacgccccaggacaaccagcugaucuacgugauccuggccauccucaccaucaucgggcugaucgccgccaacgagaugggccugaucgagaagaccaagaccgacuucggguucuaccaggugaagacggagaccaccauccucgacgucgaccugcggcccgcguccgccuggacccuguacgccguggccacgaccauccucaccccgaugcugcgccacaccaucgagaacacgagcgccaaccugucccucgcggccaucgccaaccaggccgccgugcugaugggccuggggaagggcuggccccuccaccggauggaccugggcgucccccugcucgcgauggggugcuacagccaggugaaccccaccacccugaccgccucccuggugaugcuccugguccacuacgccaucaucggcccggggcugcaggccaaggcgacgcgcgaggcccagaagcggaccgccgccggcaucaugaagaaccccaccguggacggcaucaccgugaucgaccucgagcccaucagcuacgaccccaaguucgagaagcagcuggggcaggucaugcugcucgugcugugcgccggccagcugcuccugaugcgcacgaccugggcguucugcgaggugcugacccucgccaccgggccgauccugacgcugugggagggcaaccccgggcgguucuggaacaccaccaucgccgucuccaccgccaacaucuuccgcggcagcuaccucgccggcgcggggcuggccuucucccugaucaagaacgcccagacgccccggcgcggcaccgggaccaccggcgagacgcucggggagaaguggaagcggcagcugaacagccuggaccgcaaggaguucgaggaguacaagcgguccggcauccucgagguggaccgcaccgaggccaagagcgcccugaaggacggcuccaagaucaagcacgcggugagccggggguccagcaagauccgcuggaucgucgagcgcggcauggugaagcccaaggggaagguggucgaccugggcugcgggcggggcggcuggagcuacuacauggccacccucaagaacgugaccgaggugaagggguacaccaagggcgggccgggccacgaggagcccauccccauggccacguacggguggaaccuggucaagcugcacuccggcguggacguguucuacaagcccaccgagcaggucgacacccuccugugcgacaucggcgagagcuccagcaacccgaccaucgaggaggggcgcacgcugcgggugcucaagaugguggagcccuggcuguccagcaagcccgaguucugcaucaagguccugaaccccuacaugccgaccgugaucgaggagcuggagaagcuccagcgcaagcacggcgggaaccugguccggugcccccugucccgcaacagcacccacgagauguacuggguguccggcgccagcggcaacaucguguccagcgucaacaccacguccaagaugcuccugaaccgguucaccacccgccaccggaagcccaccuacgagaaggacguggaccugggggcgggcacgcgcagcguguccaccgagaccgagaagcccgacaugaccaucaucgggcggcgccuccagcggcugcaggaggagcacaaggagacguggcacuacgaccaggagaacccguaccgcaccugggccuaccacggcagcuacgaggcccccuccaccgggagcgccuccagcauggucaacggcguggugaagcugcucaccaagcccugggacgucaucccgauggugacgcagcuggccaugaccgacaccacccccuucggccagcagcggguguucaaggagaaggucgacacgcgcaccccccagcccaagccggggacccggauggugaugaccacgaccgcgaacuggcugugggcccuccugggcaagaagaagaacccccgccugugcacccgggaggaguucaucagcaaggugcgcuccaacgccgccaucggggccgucuuccaggaggagcagggcuggaccagcgcguccgaggccgugaacgacagccgguucugggagcucguggacaaggagcgcgcccugcaccaggaggggaagugcgaguccugcgucuacaacaugaugggcaagcgcgagaagaagcugggcgaguucgggcgggccaagggcagccgcgccaucugguacauguggcucggggcgcgguuccuggaguucgaggcccugggcuuccucaacgaggaccacugguucgggcgcgagaacuccuggagcggcguggagggcgaggggcugcaccggcugggcuacauccucgaggagaucgacaagaaggacggggaccugauguacgccgacgacacggccggcugggacacccgcaucaccgaggacgaccugcagaacgaggagcucaucaccgagcagauggcgccccaccacaagauccuggccaaggccaucuucaagcugacguaccagaacaagguggucaaggugcuccggcccaccccgcgcggcgccgugauggacaucaucucccggaaggaccagcgcgggagcggccaggucgggaccuacggccugaacaccuucaccaacauggaggugcagcugauccggcagauggaggccgagggggugaucacgcaggacgacaugcagaaccccaagggccucaaggagcgcgucgagaaguggcugcgggagugcggcguggaccgccugaagcggauggcgaucuccggggacgacugcguggucaagccccucgacgagcgcuucggcaccagccugcuguuccucaacgacauggggaaggugcggaaggacaucccccagugggagccguccaagggcuggaagaacuggcaggaggugcccuucugcagccaccacuuccacaagaucuucaugaaggacgggcgcucccuggucgugcccugccggaaccaggacgagcugaucggccgcgcccgcaucagccagggcgccggguggucccuccgggagaccgccugccugggcaaggccuacgcgcagauguggagccugauguacuuccaccgccgggaccuccgccuggccagcauggccaucugcuccgccgugcccaccgagugguucccgacgagccggaccaccugguccauccacgcccaccaccaguggaugaccacggaggacaugcugaaggucuggaaccgcguguggaucgaggacaaccccaacaugaucgacaagacccccgugcacagcugggaggacauccccuaccucgggaagcgggaggaccuguggugcggcucccugaucgggcucagcucccgcgcgaccugggccaagaacauccacaccgccaucacgcagguccggaaccugaucggcaaggaggaguacguggacuacaugccggugaugaagcgcuacagcgcccccuccgagagcgagggcguccuguga

SEQ ID NO: 10445 - RNA, 9867 nt, Artificial Sequence
  derived and/or modified CDS sequence (opt1) from DENV-4__GQ199882__SS-prME
agcaccaucacccugcucugccugauccccacggugauggccuuccaccuguccacccgcgacggcgagccgcucaugaucgucgccaagcacgagcgggggcgcccccugcuguucaagaccaccgagggcaucaacaagugcacgcucaucgcgauggaccugggggagaugugcgaggacaccgugaccuacaagugcccccugcucgugaacaccgagcccgaggacaucgacugcuggugcaaccugacgagcaccugggucauguacggcaccugcacccaguccggggagcggcgccgggagaagcgcagcguggcccugacgccgcacuccggcaugggccucgagacccgggccgagaccuggaugagcuccgagggggccuggaagcacgcccagcgcguggagagcuggauccugcggaaccccggcuucgcgcugcucgccggguucauggccuacaugaucggccagaccgggauccagcgcacggucuucuucgugcugaugaugcugguggcccccuccuacggcaugcggugcgucggcguggggaaccgcgacuucguggagggcgucagcgggggcgcguggguggaccucgugcuggagcacggcgggugcgucaccaccauggcccagggcaagcccacccuggacuucgagcucacgaagaccaccgccaaggagguggcccugcugcggaccuacugcaucgaggccuccaucagcaacaucacgaccgcgacccgcugcccgacccagggggagcccuaccucaaggaggagcaggaccagcaguacaucugccggcgcgacguggucgaccggggcugggggaacggcugcggccuguucgggaagggcgggguggugacgugcgccaaguucuccugcagcggcaagaucaccgggaaccugguccagaucgagaaccucgaguacaccgugguggucaccgugcacaacggcgacacgcacgccgucggcaacgacaccuccaaccacggggugaccgccaccaucacgccccgcagccccuccguggaggucaagcugccggacuacggcgagcugacccucgacugcgagccccggagcgggaucgacuucaacgagaugauccugaugaagaugaagaagaagaccuggcuggugcacaagcagugguuccucgaccugccccugcccuggaccgccggcgcggacaccuccgaggugcacuggaacuacaaggagcgcauggucacguucaaggugccgcacgccaagcggcaggacgugaccguccucgggagccaggagggcgccaugcacagcgcccuggccggcgcgaccgagguggacuccggggacggcaaccacauguucgccgggcaccugaagugcaaggugcgcauggagaagcuccgcaucaagggcaugagcuacaccaugugcuccggcaaguucagcaucgacaaggagauggccgagacgcagcacgggaccaccgucgugaaggugaaguacgagggcgccggggcccccugcaagguccccaucgagauccgggacgugaacaaggagaagguggucggccgcgugaucuccagcaccccccuggcggagaacacgaacuccgugaccaacaucgagcuggagccgcccuucggggacagcuacaucgucaucggcgugggcaacuccgcccucacccugcacugguuccggaaggggagcuccaucggcaagauguucgagagcaccuaccgcggggccaagcggauggccauccugggcgagacggcgugggacuucggguccgugggcggccucuucaccagccuggggaaggccguccaccagguguucggcuccguguacaccaccauguucgggggcgucagcuggaugauccgcauccugaucggguuccucgugcuguggaucggcacgaacucccggaacaccagcauggccaugaccugcaucgccgugggcgggaucacccuguuccugggcuucacgguccaggccgacauggggugcgugguguccuggagcggccgcgagcucaagugcgggagcggcaucuucgucguggacaacgugcacaccuggaccgagcaguacaaguuccagcccgagucccccgcgcggcuggccagcgccauccugaacgcccacaaggacggcgucugcgggauccgcuccaccacgcggcucgagaacgugauguggaagcagaucaccaacgagcugaacuacgugcugugggagggcgggcacgaccucaccgucguggccggcgacgugaagggcguccugaccaaggggaagcgcgcgcugacgccgcccgugagcgaccucaaguacuccuggaagaccuggggcaaggccaagaucuucacccccgaggcccggaacagcaccuuccugaucgacgggcccgacacguccgagugcccgaacgagcgccgggccuggaacagccuggagguggaggacuacggcuucgggauguucaccaccaacaucuggaugaaguuccgcgagggcuccagcgaggucugcgaccaccggcucauguccgccgcgaucaaggaccagaaggccgugcacgccgacaugggcuacuggaucgagagcuccaagaaccagaccuggcagaucgagaaggccagccugaucgaggugaagacgugccuguggcccaagacccacacccucugguccaacgggguccuggagagccagaugcugauccccaaguccuacgcgggcccguucagccagcacaacuaccgccagggguacgccacccagaccgugggccccuggcaccucgggaagcuggagaucgacuucggcgagugccccggcacgaccgugaccauccaggaggacugcgaccaccgggggcccagccugcgcaccacgaccgccuccggcaagcucgucacccaguggugcugccgcagcugcaccaugccgccccugcgguuccugggggaggacggcugcugguacgggauggagauccgcccccucuccgagaaggaggagaacauggugaagagccaggucgccgccggccagggcacguccgagaccuucagcauggggcugcugugccucacccuguucguggaggagugccugcggcgccgggugacccgcaagcacaugauccucgcggucgugaucacgcugugcgccaucauccugggcgggcucaccuggauggaccugcugcgggcccucaucaugcugggcgacaccauguccggccgcaucgggggccagacccaccuggccaucauggccguguucaagaugagccccggguacguccucggcguguuccugcggaagcugacgucccgcgagaccgcgcucauggugaucgggauggccaugaccaccacgcugagcaucccgcacgaccugauggagcucaucgacggcaucucccugggccugauccuccugaagaucgucacccaguucgacaacacccagguggggacccuggcccucagccugacguucauccgguccaccaugagccuggugauggccuggcgcaccaucauggccguccucuucguggugacccugaucccccugugccggacguccugccuccagaagcagagccacugggucgagaucaccgcgcugauccugggcgcccaggcccuccccguguaccugaugacccugaugaagggggccucccgccggagcuggccccucaacgagggcaucauggcgguggggcuggucucccugcucggcagcgcccugcugaagaacgacgugccgcucgccggccccaugguggccgggggccugcugcucgccgcguacgucaugagcggguccagcgccgaccugucccuggagaaggccgccaacgugcagugggacgagauggccgacaucaccggcagcucccccaucaucgaggugaagcaggacgaggacgggagcuucuccauccgcgacgucgaggagacgaacaugaucacccuccuggugaagcuggcgcucaucaccgugagcggccuguacccccuggccaucccggucaccaugacgcucugguacauguggcaggugaagacccagcgguccggcgcccugugggacgugcccagccccgccgccacccagaaggcggcccuguccgagggggucuaccgcaucaugcagcggggccucuucgggaagacccaggugggcguggggauccacauggagggcgucuuccacaccauguggcacgugacgcgcggcagcgugaucugccacgagaccgggcggcuggagcccuccugggccgacguccgcaacgacaugaucagcuacggcgggggcuggcgccugggcgacaagugggacaaggaggaggacgugcaggugcucgccaucgagccggggaagaaccccaagcacguccagaccaagcccggccuguucaagacccugacgggggagaucggcgccgugacccucgacuucaagcccgggaccuccggcagcccgaucaucaaccggaagggcaaggugaucgggcuguacggcaacggggucgugaccaaguccggcgacuacgugagcgcgaucacgcaggccgagcgcaucggggagcccgacuacgaggucgacgaggacaucuuccggaagaagcgccugaccaucauggaccuccaccccggcgccggcaagaccaagcggauccugccguccaucgugcgcgaggcccugaagcggcgccugcggacccucauccuggcgcccacgcgcguggucgccgccgagauggaggaggcccugcgggggcuccccauccgcuaccagacccccgccgugaagagcgagcacaccggccgggagaucguggaccugaugugccacgcgaccuucacgacccgccugcucagcuccacccgggucccgaacuacaaccugaucgugauggacgaggcccacuucaccgaccccagcuccgucgccgcccgcggguacaucagcacgcggguggagaugggcgaggccgcggccaucuucaugaccgccaccccccccggggccaccgacccguucccccaguccaacagccccaucgaggacaucgagcgcgagauccccgagcgguccuggaacacgggcuucgacuggaucaccgacuaccagggcaagaccgugugguucgucccgagcaucaaggccgggaacgacaucgcgaacugccugcgcaaguccggcaagaaggugauccagcucagccgcaagaccuucgacacggaguaccccaagaccaagcugaccgacugggacuucguggucaccacggacaucuccgagaugggggccaacuuccgggccggccgcgugaucgacccccggcgcugccugaagcccgugauccucaccgacgggagcgagcgggucauccuggccggcccgauccccgugacccccgcguccgccgcccagcgccggggccgcaucgggcggaaccccgcccaggaggacgaccaguacguguucagcggcgacccgcugaagaacgacgaggaccacgcccacuggaccgaggcgaagaugcuccuggacaacaucuacacgcccgaggggaucauccccacccuguucggccccgagcgcgagaagacccaggccaucgacggcgaguuccggcuccgcggggagcagcggaagaccuucgucgagcugaugcgccggggcgaccugccgguguggcucuccuacaagguggccagcgccgggaucuccuacaaggaccgcgaguggugcuucacgggcgagcggaacaaccagauccuggaggagaacauggaggucgagaucuggacccgcgagggggagaagaagaagcugcggccccgcuggcucgacgcccggguguacgcggaccccauggcccugaaggacuucaaggaguucgccagcggccgcaaguccaucacccuggacauccucaccgagaucgccagccugcccaccuaccugagcucccgcgccaagcucgcgcuggacaacaucgugaugcugcacacgaccgagcggggcgggcgcgccuaccagcacgcccucaacgagcugccggagagccuggagacccucaugcuggucgcccugcucggcgcgaugaccgccgggaucuuccuguucuucaugcagggcaaggggaucggcaagcuguccaugggccucaucacgaucgccguggccagcgggcugcuguggguggccgagauccagccccaguggaucgcggccuccaucauccucgaguucuuccugaugguccugcucauccccgagccggagaagcagcggaccccccaggacaaccagcugaucuacgugauccugaccauccucaccaucaucggccugaucgccgccaacgagauggggcugaucgagaagacgaagaccgacuucggcuucuaccaggugaagaccgagaccacgauccucgacgucgaccugcgccccgccagcgcguggacccuguacgccguggccaccaccauccucacgcccaugcugcggcacaccaucgagaacaccuccgccaaccugagccucgccgcgaucgccaaccaggccgccgugcugauggggcugggcaagggcuggccgcuccaccgcauggaccugggggucccccugcucgccaugggcugcuacucccaggugaaccccaccacgcugaccgcgagccuggugaugcuccugguccacuacgccaucaucgggcccggccugcaggccaaggccacccgggaggcgcagaagcgcaccgccgccggcaucaugaagaacccgacgguggacgggaucaccgugaucgaccucgagcccaucuccuacgaccccaaguucgagaagcagcugggccaggucaugcugcucgugcugugcgccgggcagcugcuccugaugcggaccaccugggccuucugcgaggugcugacgcucgcgaccggccccauccugacccugugggaggggaacccgggccgcuucuggaacaccacgaucgccgucagcaccgccaacaucuuccggggcuccuaccucgccggggccggccuggcguucagccugaucaagaacgcccagaccccccgccgggggaccggcacgaccggggagacccucggcgagaaguggaagcgccagcugaacucccuggaccggaaggaguucgaggaguacaagcgcagcggcauccucgagguggaccggaccgaggccaaguccgcccugaaggacgggagcaagaucaagcacgccgugucccgcggcagcagcaagauccgguggaucgucgagcgcgggauggugaagcccaagggcaagguggucgaccuggggugcggccgcggcgggugguccuacuacauggcgacccucaagaacgugacggaggugaagggcuacaccaaggggggccccgggcacgaggagccgauccccauggccaccuacggcuggaaccuggucaagcugcacagcggcguggacguguucuacaagcccaccgagcaggucgacacgcuccugugcgacaucggggaguccagcuccaaccccaccaucgaggagggccggacccugcgcgugcucaagaugguggagccguggcugagcuccaagcccgaguucugcaucaagguccugaaccccuacaugcccaccgugaucgaggagcuggagaagcuccagcggaagcacgggggcaaccugguccgcugcccgcugagccggaacuccacgcacgagauguacugggugagcggcgccuccgggaacaucgugagcuccgucaacaccaccagcaagaugcuccugaaccgcuucaccacgcggcaccgcaagcccaccuacgagaaggacguggaccugggcgccgggacccgguccgugagcaccgagacggagaagcccgacaugaccaucaucggccgccggcuccagcgccugcaggaggagcacaaggagaccuggcacuacgaccaggagaaccccuaccggaccugggcguaccacggguccuacgaggccccgagcacgggcuccgccagcagcauggucaacggcguggugaagcugcucaccaagcccugggacgucauccccauggugacccagcuggccaugaccgacacgaccccguucgggcagcagcgcguguucaaggagaaggucgacacccggaccccccagcccaagcccggcacgcgcauggugaugaccaccaccgccaacuggcugugggcgcuccuggggaagaagaagaacccgcggcugugcacgcgcgaggaguucaucuccaaggugcggagcaacgccgccaucggcgccgucuuccaggaggagcagggguggaccuccgccagcgaggcggugaacgacucccgcuucugggagcucguggacaaggagcgggcccugcaccaggagggcaagugcgagagcugcgucuacaacaugaugggcaagcgcgagaagaagcugggggaguucggccgcgccaaggggucccgggccaucugguacauguggcucggcgcccgcuuccuggaguucgaggcgcugggguuccucaacgaggaccacugguucggccgggagaacagcugguccggcguggagggggagggccugcaccgccugggguacauccucgaggagaucgacaagaaggacggcgaccugauguacgccgacgacaccgccggcugggacacccggaucacggaggacgaccugcagaacgaggagcucaucaccgagcagauggccccccaccacaagauccuggcgaaggccaucuucaagcugaccuaccagaacaagguggucaaggugcuccgccccaccccccggggggccgugauggacaucaucagccgcaaggaccagcggggcuccgggcaggucggcaccuacgggcugaacacguucaccaacauggaggugcagcugauccgccagauggaggccgagggcgugaucacccaggacgacaugcagaacccgaagggccucaaggagcgggucgagaaguggcugcgcgagugcgggguggaccggcugaagcgcauggccaucagcggcgacgacugcguggucaagccccucgacgagcgguucgggaccucccugcuguuccucaacgacaugggcaaggugcgcaaggacaucccccagugggagcccagcaagggguggaagaacuggcaggaggugccguucugcucccaccacuuccacaagaucuucaugaaggacggccggagccuggucgugcccugccgcaaccaggacgagcugaucggccgggcgcgcaucucccagggggccggcuggagccuccgcgagacggccugccuggggaaggccuacgcccagauguggagccugauguacuuccaccggcgcgaccuccggcuggcguccauggccaucugcagcgccgugcccaccgagugguuccccaccucccgcaccacguggagcauccacgcccaccaccaguggaugaccaccgaggacaugcugaaggucuggaaccggguguggaucgaggacaacccgaacaugaucgacaagacccccgugcacuccugggaggacauccccuaccucggcaagcgcgaggaccuguggugcgggagccugaucggccucuccagccgggccacgugggcgaagaacauccacaccgccaucacccagguccgcaaccugaucggcaaggaggaguacguggacuacaugcccgugaugaagcgguacuccgccccgagcgaguccgaggggguccuguga

SEQ ID NO: 10446 - RNA, 9867 nt, Artificial Sequence
  derived and/or modified CDS sequence (opt1) from DENV-4__GQ199883__SS-prME
agcaccaucacccugcucugccugauccccacggugauggccuuccaccuguccacccgcgacggcgagccgcucaugaucgucgccaagcacgagcgggggcgcccccugcuguucaagaccaccgagggcaucaacaagugcacgcucaucgcgauggaccugggggagaugugcgaggacaccgugaccuacaagugcccccugcucgugaacaccgagcccgaggacaucgacugcuggugcaaccugacgagcaccugggucauguacggcaccugcacccaguccggggagcggcgccgggagaagcgcagcguggcccugacgccgcacuccggcaugggccucgagacccgggccgagaccuggaugagcuccgagggggccuggaagcacgcccagcgcguggagagcuggauccugcggaaccccggcuucgcgcugcucgccggguucauggccuacaugaucggccagaccgggauccagcgcacggucuucuucgugcugaugaugcugguggcccccuccuacggcaugcggugcgucggcguggggaaccgcgacuucguggagggcgucagcgggggcgcguggguggaccucgugcuggagcacggcgggugcgucaccaccauggcccagggcaagcccacccuggacuucgagcucacgaagaccaccgccaaggagguggcccugcugcggaccuacugcaucgaggccuccaucagcaacaucacgaccgcgacccgcugcccgacccagggggagcccuaccucaaggaggagcaggaccagcaguacaucugccggcgcgacguggucgaccggggcugggggaacggcugcggccuguucgggaagggcgggguggugacgugcgccaaguucuccugcagcggcaagaucaccgggaaccugguccagaucgagaaccucgaguacaccgugguggucaccgugcacaacggcgacacgcacgccgucggcaacgacaccuccaaccacggggugaccgccaccaucacgccccgcagccccuccgccgaggugaagcugccggacuacggcgagcugacccucgacugcgagccccggagcgggaucgacuucaacgagaugauccugaugaagaugaagaagaagaccuggcugguccacaagcagugguuccucgaccugccccugcccuggaccgcgggcgccgacaccuccgaggugcacuggaacuacaaggagcgcauggugacguucaaggucccgcacgccaagcggcaggacgugaccgugcucgggagccaggagggcgccaugcacagcgcccuggcgggcgccaccgaggucgacuccggggacggcaaccacauguucgccgggcaccugaagugcaaggugcgcauggagaagcuccgcaucaagggcaugagcuacaccaugugcuccggcaaguucagcaucgacaaggagauggccgagacgcagcacgggaccaccguggucaaggugaaguacgagggcgccggggcgcccugcaaggugcccaucgagauccgggacgucaacaaggagaagguggugggccgcgucaucuccagcaccccccuggccgagaacacgaacuccgugaccaacaucgagcuggagccgcccuucggggacagcuacaucgugaucggcgucggcaacuccgcccucacccugcacugguuccggaaggggagcuccaucggcaagauguucgagagcaccuaccgcggggccaagcggauggcgauccugggcgagacggccugggacuucggguccgugggcggccucuucaccagccuggggaaggccgugcaccaggucuucggcuccguguacaccaccauguucgggggcgugagcuggaugauccgcauccugaucggguuccucguccuguggaucggcacgaacucccggaacaccagcauggccaugaccugcaucgccgugggcgggaucacccuguuccugggcuucacggugcaggcggacauggggugcgucguguccuggagcggccgcgagcucaagugcgggagcggcaucuucguggucgacaacgugcacaccuggaccgagcaguacaaguuccagcccgagucccccgcccggcuggccagcgccauccugaacgcccacaaggacggcgugugcgggauccgcuccaccacgcggcucgagaacgucauguggaagcagaucaccaacgagcugaacuacgugcugugggagggcgggcacgaccucaccguggucgcgggcgacgugaagggcgugcugaccaaggggaagcgcgcccugacgccgcccgucagcgaccucaaguacuccuggaagaccuggggcaaggccaagaucuucacccccgaggcccggaacagcaccuuccugaucgacgggcccgacacguccgagugcccgaacgagcgccgggccuggaacagccuggagguggaggacuacggcuucgggauguucaccaccaacaucuggaugaaguuccgcgagggcuccagcgaggugugcgaccaccggcucauguccgcggccaucaaggaccagaaggccguccacgccgacaugggcuacuggaucgagagcuccaagaaccagaccuggcagaucgagaaggcgagccugaucgaggugaagacgugccuguggcccaagacccacacccucugguccaacggggugcuggagagccagaugcugauccccaaguccuacgccggcccguucagccagcacaacuaccgccagggguacgccacccagaccgucggccccuggcaccucgggaagcuggagaucgacuucggcgagugccccggcacgaccgugaccauccaggaggacugcgaccaccgggggcccagccugcgcaccacgaccgccuccggcaagcucgugacccaguggugcugccgcagcugcaccaugccgccccugcgguuccugggggaggacggcugcugguacgggauggagauccgcccccucuccgagaaggaggagaacauggucaagagccagguggccgcgggccagggcacguccgagaccuucagcauggggcugcugugccucacccuguucgucgaggagugccugcggcgccgggugacccgcaagcacaugauccucgccguggucaucacgcugugcgccaucauccugggcgggcucaccuggauggaccugcugcgggcccucaucaugcugggcgacaccauguccggccgcaucgggggccagacccaccuggccaucauggcgguguucaagaugagccccggguacgugcucggcgucuuccugcggaagcugacgucccgcgagaccgcccucauggugaucgggauggccaugaccaccacgcugagcaucccgcacgaccugauggagcucaucgacggcaucucccugggccugauccuccugaagaucgugacccaguucgacaacacccaggucgggacccuggcccucagccugacguucauccgguccaccaugagccuggugauggccuggcgcaccaucauggcggugcucuucgucgugacccugaucccccugugccggacguccugccuccagaagcagagccacuggguggagaucaccgcccugauccugggcgcccaggcccuccccgucuaccugaugacccugaugaagggggcgucccgccggagcuggccccucaacgagggcaucauggccguggggcuggugucccugcucggcagcgcccugcugaagaacgacgucccgcucgccggccccaugguggccgggggccugcugcucgcggccuacgugaugagcggguccagcgccgaccugucccuggagaaggccgccaacguccagugggacgagauggcggacaucaccggcagcucccccaucaucgaggugaagcaggacgaggacgggagcuucuccauccgcgacguggaggagacgaacaugaucacccuccuggucaagcuggcccucaucaccgugagcggccuguacccccuggccaucccggugaccaugacgcucugguacauguggcaggucaagacccagcgguccggcgcccugugggacgugcccagccccgccgcgacccagaaggccgcccuguccgaggggguguaccgcaucaugcagcggggccucuucgggaagacccaggucggcguggggauccacauggagggcguguuccacaccauguggcacgucacgcgcggcagcgugaucugccacgagaccgggcggcuggagcccuccugggccgacgugcgcaacgacaugaucagcuacggcgggggcuggcgccugggcgacaagugggacaaggaggaggacguccaggugcucgccaucgagccggggaagaaccccaagcacgugcagaccaagcccggccuguucaagacccugacgggggagaucggcgcggucacccucgacuucaagcccgggaccuccggcagcccgaucaucaaccggaagggcaaggugaucgggcuguacggcaacgggguggucaccaaguccggcgacuacgugagcgccaucacgcaggccgagcgcaucggggagcccgacuacgagguggacgaggacaucuuccggaagaagcgccugaccaucauggaccuccaccccggcgccggcaagaccaagcggauccugccguccaucguccgcgaggcgcugaagcggcgccugcggacccucauccuggcccccacgcgcgugguggccgccgagauggaggaggcccugcgggggcuccccauccgcuaccagacccccgcggucaagagcgagcacaccggccgggagaucguggaccugaugugccacgccaccuucacgacccgccugcucagcuccacccgggugccgaacuacaaccugaucgucauggacgaggcccacuucaccgaccccagcuccguggccgcccgcggguacaucagcacgcgggucgagaugggcgaggcggccgccaucuucaugaccgccaccccccccggggccaccgacccguucccccaguccaacagccccaucgaggacaucgagcgcgagauccccgagcgguccuggaacacgggcuucgacuggaucaccgacuaccagggcaagaccgugugguucgugccgagcaucaaggcggggaacgacaucgccaacugccugcgcaaguccggcaagaaggucauccagcucagccgcaagaccuucgacacggaguaccccaagaccaagcugaccgacugggacuucguggugaccacggacaucuccgagaugggggccaacuuccgggccggccgcgucaucgacccccggcgcugccugaagcccgugauccucaccgacgggccggagcgggugauccuggcgggccccauccccgucacccccgccagcgccgcccagcgccggggccgcaucgggcggaacccggcccaggaggacgaccaguacguguucuccggcgacccccugaagaacgacgaggaccacgcgcacuggaccgaggccaagaugcuccuggacaacaucuacacgcccgaggggaucauccccacccuguucggcccggagcgcgagaagacccaggccaucgacggcgaguuccggcuccgcggggagcagcggaagaccuucguggagcugaugcgccggggcgaccugcccgucuggcucagcuacaagguggccuccgccgggaucagcuacaaggaccgcgaguggugcuucacgggcgagcggaacaaccagauccuggaggagaacauggagguggagaucuggacccgcgagggggagaagaagaagcugcggccccgcuggcucgacgcgcgggucuacgccgaccccauggcccugaaggacuucaaggaguucgccuccggccgcaagagcaucacccuggacauccucaccgagaucgccucccugccgaccuaccugagcagccgcgcgaagcucgcccuggacaacaucgugaugcugcacacgaccgagcggggcgggcgcgccuaccagcacgcccucaacgagcugcccgagucccuggagacccucaugcugguggcgcugcucggcgccaugaccgccgggaucuuccuguucuucaugcagggcaaggggaucggcaagcugagcaugggccucaucacgaucgccgucgccuccgggcugcuguggguggcggagauccagccccaguggaucgccgccagcaucauccucgaguucuuccugauggugcugcucaucccggagcccgagaagcagcggaccccccaggacaaccagcugaucuacgucauccuggccauccucaccaucaucggccugaucgccgcgaacgagauggggcugaucgagaagaccaagacggacuucggcuucuaccaggugaagaccgagaccaccauccucgacguggaccugcgccccgccuccgccuggacgcuguacgccgucgccaccaccauccucaccccgaugcugcggcacacgaucgagaacaccagcgcgaaccugucccucgccgccaucgccaaccaggccgcggugcugauggggcugggcaagggcuggccccuccaccgcauggaccugggggugccccugcucgccaugggcugcuacagccaggucaaccccaccacccugacggccucccuggugaugcuccuggugcacuacgccaucaucgggccgggccugcaggcgaaggccacccgggaggcccagaagcgcaccgccgccggcaucaugaagaaccccaccgucgacgggaucacggugaucgaccucgagcccaucagcuacgaccccaaguucgagaagcagcugggccaggugaugcugcucguccugugcgcggggcagcugcuccugaugcggaccaccugggccuucugcgaggugcugacccucgccacgggcccgauccugacccugugggaggggaaccccggccgcuucuggaacaccaccaucgccguguccacggccaacaucuuccggggcagcuaccucgcgggggccggccuggccuucucccugaucaagaacgcccagaccccccgccgggggaccggcaccacgggggagacccucggcgagaaguggaagcgccagcugaacagccuggaccggaaggaguucgaggaguacaagcgcuccggcauccucgaggucgaccggaccgaggccaagagcgcgcugaaggacggguccaagaucaagcacgccgugagccgcggcuccagcaagauccgguggaucguggagcgcgggauggucaagcccaagggcaaggugguggaccuggggugcggccgcggcggguggagcuacuacauggccacccucaagaacgucaccgaggugaagggcuacacgaaggggggcccggggcacgaggagcccauccccauggccaccuacggcuggaaccuggugaagcugcacuccggcgucgacguguucuacaagcccaccgagcagguggacacccuccugugcgacaucggggagagcuccagcaacccgacgaucgaggagggccggacccugcgcguccucaagaugguggagcccuggcuguccagcaagcccgaguucugcaucaaggugcugaaccccuacaugccgaccgucaucgaggagcuggagaagcuccagcggaagcacgggggcaaccuggugcgcugcccccugucccggaacagcacccacgagauguacugggucuccggcgcgagcgggaacaucguguccagcgugaacacgaccuccaagaugcuccugaaccgcuucaccacccggcaccgcaagcccacguacgagaaggacgucgaccugggcgccgggacccggagcguguccaccgagaccgagaagcccgacaugacgaucaucggccgccggcuccagcgccugcaggaggagcacaaggagaccuggcacuacgaccaggagaacccguaccggaccugggccuaccacgggagcuacgaggcccccuccaccggcagcgccuccagcauggugaacggcgucgugaagcugcucacgaagcccugggacgugaucccgauggucacccagcuggcgaugaccgacaccacgcccuucgggcagcagcgcguguucaaggagaagguggacacccggaccccccagcccaagccgggcacccgcauggucaugacgaccaccgccaacuggcugugggcccuccuggggaagaagaagaacccccggcugugcacccgcgaggaguucaucagcaaggugcgguccaacgccgccaucggcgcgguguuccaggaggagcagggguggacgagcgccuccgaggccgucaacgacagccgcuucugggagcucguggacaaggagcgggcccugcaccaggagggcaagugcgaguccugcguguacaacaugaugggcaagcgcgagaagaagcugggggaguucggccgcgccaaggggagccgggcgaucugguacauguggcucggcgcccgcuuccuggaguucgaggcccugggguuccucaacgaggaccacugguucggccgggagaacuccuggagcggcgucgagggggagggccugcaccgccugggguacauccucgaggagaucgacaagaaggacggcgaccugauguacgccgacgacaccgcgggcugggacacccggaucaccgaggacgaccugcagaacgaggagcucaucacggagcagauggccccccaccacaagauccuggccaaggccaucuucaagcugaccuaccagaacaagguggugaagguccuccgccccaccccgcggggggccgugauggacaucaucucccgcaaggaccagcggggcagcgggcaggugggcaccuacgggcugaacaccuucacgaacauggagguccagcugauccgccagauggaggcggagggcgugaucacccaggacgacaugcagaaccccaagggccucaaggagcggguggagaaguggcugcgcgagugcggggucgaccggcugaagcgcauggccaucuccggcgacgacugcguggugaagccccucgacgagcgguucgggaccagccugcuguuccucaacgacaugggcaagguccgcaaggacaucccccagugggagccguccaagggguggaagaacuggcaggaggugcccuucugcagccaccacuuccacaagaucuucaugaaggacggccggucccuggugguccccugccgcaaccaggacgagcugaucggccgggcccgcaucagccagggggccggcuggucccuccgcgagaccgccugccuggggaaggcguacgcccagauguggagccugauguacuuccaccggcgcgaccuccggcuggccagcauggccaucugcuccgccgugcccacggagugguucccgaccagccgcaccaccugguccauccacgcgcaccaccaguggaugacgaccgaggacaugcugaagguguggaaccgggucuggaucgaggacaaccccaacaugaucgacaagacccccgugcacagcugggaggacauccccuaccucggcaagcgcgaggaccuguggugcgggucccugaucggccucagcucccgggccaccugggccaagaacauccacacggccaucacccaggugcgcaaccugaucggcaaggaggaguacgucgacuacaugccggugaugaagcgguacagcgcccccuccgagagcgagggggugcuguga

SEQ ID NO: 10447 - RNA, 9867 nt, Artificial Sequence
  derived and/or modified CDS sequence (opt1) from DENV-4__GQ199884__SS-prME
agcaccaucacccugcucugccugauccccacggugauggccuuccaccuguccacccgcgacggcgagccgcucaugaucgucgccaagcacgagcgggggcgcccccugcuguucaagaccaccgagggcaucaacaagugcacgcucaucgcgauggaccugggggagaugugcgaggacaccgugaccuacaagugcccccugcucgugaacaccgagcccgaggacaucgacugcuggugcaaccugacgagcaccugggucauguacggcaccugcacccaguccggggagcggcgccgggagaagcgcagcguggcccugacgccgcacuccggcaugggccucgagacccgggccgagaccuggaugagcuccgagggggccuggaagcacgcccagcgcguggagagcuggauccugcggaaccccggcuucgcgcugcucgccggguucauggccuacaugaucggccagaccgggauccagcgcacggucuucuucgugcugaugaugcugguggcccccuccuacggcaugcggugcgucggcguggggaaccgcgacuucguggagggcgucagcgggggcgcguggguggaccucgugcuggagcacggcgggugcgucaccaccauggcccagggcaagcccacccuggacuucgagcucacgaagaccaccgccaaggagguggcccugcugcggaccuacugcaucgaggccuccaucagcaacaucacgaccgcgacccgcugcccgacccagggggagcccuaccucaaggaggagcaggaccagcaguacaucugccggcgcgacguggucgaccggggcugggggaacggcugcggccuguucgggaagggcgggguggugacgugcgccaaguucuccugcagcggcaagaucaccgggaaccugguccagaucgagaaccucgaguacaccgugguggucaccgugcacaacggcgacacgcacgccgucggcaacgacaccuccaaccacggggugaccgccaccaucacgccccgcagccccuccguggaggucaagcugccggacuacggcgagcugacccucgacugcgagccccggagcgggaucgacuucaacgagaugauccugaugaagaugaagaagaagaccuggcuggugcacaagcagugguuccucgaccugccccugcccuggaccgccggcgcggacaccuccgaggugcacuggaacuacaaggagcgcauggucacguucaaggugccgcacgccaagcggcaggacgugaccguccucgggagccaggagggcgccaugcacagcgcccuggccggcgcgaccgagguggacuccggggacggcaaccacauguucgccgggcaccugaagugcaaggugcgcauggagaagcuccgcaucaagggcaugagcuacaccaugugcuccggcaaguucagcaucgacaaggagauggccgagacgcagcacgggaccaccgucgugaaggugaaguacgagggcgccggggcccccugcaagguccccaucgagauccgggacgugaacaaggagaagguggucggccgcgugaucuccagcaccccccuggcggagaacacgaacuccgugaccaacaucgagcuggagccgcccuucggggacagcuacaucgucaucggcgugggcaacuccgcccucacccugcacugguuccggaaggggagcuccaucggcaagauguucgagagcaccuaccgcggggccaagcggauggccauccugggcgagacggcgugggacuucggguccgugggcggccucuucaccagccuggggaaggccguccaccagguguucggcuccguguacaccaccauguucgggggcgucagcuggaugauccgcauccugaucggguuccucgugcuguggaucggcacgaacucccggaacaccagcauggccaugaccugcaucgccgugggcgggaucacccuguuccugggcuucacgguccaggccgacauggggugcgugguguccuggagcggccgcgagcucaagugcgggagcggcaucuucgucguggacaacgugcacaccuggaccgagcaguacaaguuccagcccgagucccccgcgcggcuggccagcgccauccugaacgcccacaaggacggcgucugcgggauccgcuccaccacgcggcucgagaacgugauguggaagcagaucaccaacgagcugaacuacgugcugugggagggcgggcacgaccucaccgucguggccggcgacgugaagggcguccugaccaaggggaagcgcgcgcugacgccgcccgugagcgaccucaaguacuccuggaagaccuggggcaaggccaagaucuucacccccgaggcccggaacagcaccuuccugaucgacgggcccgacacguccgagugcccgaacgagcgccgggccuggaacagccuggagguggaggacuacggcuucgggauguucaccaccaacaucuggaugaaguuccgcgagggcuccagcgaggucugcgaccaccggcucauguccgccgcgaucaaggaccagaaggccgugcacgccgacaugggcuacuggaucgagagcuccaagaaccagaccuggcagaucgagaaggccagccugaucgaggugaagacgugccuguggcccaagacccacacccucugguccaacgggguccuggagagccagaugcugauccccaaguccuacgcgggcccguucagccagcacaacuaccgccagggguacgccacccagaccgugggccccuggcaccucgggaagcuggagaucgacuucggcgagugccccggcacgaccgugaccauccaggaggacugcgaccaccgggggcccagccugcgcaccacgaccgccuccggcaagcucgucacccaguggugcugccgcagcugcaccaugccgccccugcgguuccugggggaggacggcugcugguacgggauggagauccgcccccucuccgagaaggaggagaacauggugaagagccaggucgccgccggccagggcacguccgagaccuucagcauggggcugcugugccucacccuguucguggaggagugccugcggcgccgggugacccgcaagcacaugauccucgcggucgugaucacgcugugcgccaucauccugggcgggcucaccuggauggaccugcugcgggcccucaucaugcugggcgacaccauguccggccgcaucgggggccagacccaccuggccaucauggccguguucaagaugagccccggguacguccucggcguguuccugcggaagcugacgucccgcgagaccgcgcucauggugaucgggauggccaugaccaccacgcugagcaucccgcacgaccugauggagcucaucgacggcaucucccugggccugauccuccugaagaucgucacccaguucgacaacacccagguggggacccuggcccucagccugacguucauccgguccaccaugagccuggugauggccuggcgcaccaucauggccguccucuucguggugacccugaucccccugugccggacguccugccuccagaagcagagccacugggucgagaucaccgcgcugauccugggcgcccaggcccuccccguguaccugaugacccugaugaagggggccucccgccggagcuggccccucaacgagggcaucauggcgguggggcuggucucccugcucggcagcgcccugcugaagaacgacgugccgcucgccggccccaugguggccgggggccugcugcucgccgcguacgucaugagcggguccagcgccgaccugucccuggagaaggccgccaacgugcagugggacgagauggccgacaucaccggcagcucccccaucaucgaggugaagcaggacgaggacgggagcuucuccauccgcgacgucgaggagacgaacaugaucacccuccuggugaagcuggcgcucaucaccgugagcggccuguacccccuggccaucccggucaccaugacgcucugguacauguggcaggugaagacccagcgguccggcgcccugugggacgugcccagccccgccgccacccagaaggcggcccuguccgagggggucuaccgcaucaugcagcggggccucuucgggaagacccaggugggcguggggauccacauggagggcgucuuccacaccauguggcacgugacgcgcggcagcgugaucugccacgagaccgggcggcuggagcccuccugggccgacguccgcaacgacaugaucagcuacggcgggggcuggcgccugggcgacaagugggacaaggaggaggacgugcaggugcucgccaucgagccggggaagaaccccaagcacguccagaccaagcccggccuguucaagacccugacgggggagaucggcgccgugacccucgacuucaagcccgggaccuccggcagcccgaucaucaaccggaagggcaaggugaucgggcuguacggcaacggggucgugaccaaguccggcgacuacgugagcgcgaucacgcaggccgagcgcaucggggagcccgacuacgaggucgacgaggacaucuuccggaagaagcgccugaccaucauggaccuccaccccggcgccggcaagaccaagcggauccugccguccaucgugcgcgaggcccugaagcggcgccugcggacccucauccuggcgcccacgcgcguggucgccgccgagauggaggaggcccugcgggggcuccccauccgcuaccagacccccgccgugaagagcgagcacaccggccgggagaucguggaccugaugugccacgcgaccuucacgacccgccugcucagcuccacccgggucccgaacuacaaccugaucgugauggacgaggcccacuucaccgaccccagcuccgucgccgcccgcggguacaucagcacgcggguggagaugggcgaggccgcggccaucuucaugaccgccaccccccccggggccaccgacccguucccccaguccaacagccccaucgaggacaucgagcgcgagauccccgagcgguccuggaacacgggcuucgacuggaucaccgacuaccagggcaagaccgugugguucgucccgagcaucaaggccgggaacgacaucgcgaacugccugcgcaaguccggcaagaaggugauccagcucagccgcaagaccuucgacacggaguaccccaagaccaagcugaccgacugggacuucguggucaccacggacaucuccgagaugggggccaacuuccgggccggccgcgugaucgacccccggcgcugccugaagcccgugauccucaccgacgggccggagcgggucauccuggccggccccauccccgugacccccgcgagcgccgcccagcgccggggccgcaucgggcggaacccggcccaggaggacgaccaguacguguucuccggcgacccccugaagaacgacgaggaccacgcccacuggaccgaggcgaagaugcuccuggacaacaucuacacgcccgaggggaucauccccacccuguucggcccggagcgcgagaagacccaggccaucgacggcgaguuccggcuccgcggggagcagcggaagaccuucgucgagcugaugcgccggggcgaccugcccguguggcucagcuacaagguggccuccgccgggaucagcuacaaggaccgcgaguggugcuucacgggcgagcggaacaaccagauccuggaggagaacauggaggucgagaucuggacccgcgagggggagaagaagaagcugcggccccgcuggcucgacgcccggguguacgcggaccccauggcccugaaggacuucaaggaguucgccuccggccgcaagagcaucacccuggacauccucaccgagaucgccucccugccgaccuaccugagcagccgcgccaagcucgcgcuggacaacaucgugaugcugcacacgaccgagcggggcgggcgcgccuaccagcacgcccucaacgagcugcccgagucccuggagacccucaugcuggucgcccugcucggcgcgaugaccgccgggaucuuccuguucuucaugcagggcaaggggaucggcaagcugagcaugggccucaucacgaucgccguggccuccgggcugcuguggguggccgagauccagccccaguggaucgcggccagcaucauccucgaguucuuccugaugguccugcucaucccggagcccgagaagcagcggaccccccaggacaaccagcugaucuacgugauccuggccauccucaccaucaucggccugaucgccgccaacgagauggggcugaucgagaagaccaagacggacuucggcuucuaccaggugaagaccgagaccaccauccucgacgucgaccugcgccccgcguccgccuggacgcuguacgccguggccaccaccauccucaccccgaugcugcggcacacgaucgagaacaccagcgccaaccugucccucgcggccaucgccaaccaggccgccgugcugauggggcugggcaagggcuggccccuccaccgcauggaccugggggucccccugcucgcgaugggcugcuacagccaggugaaccccaccacccugacggccucccuggugaugcuccugguccacuacgccaucaucgggccgggccugcaggccaaggcgacccgggaggcccagaagcgcaccgccgccggcaucaugaagaaccccaccguggacgggaucacggugaucgaccucgagcccaucagcuacgaccccaaguucgagaagcagcugggccaggucaugcugcucgugcugugcgccgggcagcugcuccugaugcggaccaccugggcguucugcgaggugcugacccucgccacgggcccgauccugacccugugggaggggaaccccggccgcuucuggaacaccaccaucgccgucuccacggccaacaucuuccggggcagcuaccucgccggggcgggccuggccuucucccugaucaagaacgcccagaccccccgccgggggaccggcaccacgggggagacccucggcgagaaguggaagcgccagcugaacagccuggaccggaaggaguucgaggaguacaagcgcuccggcauccucgagguggaccggaccgaggccaagagcgcccugaaggacggguccaagaucaagcacgcggugagccgcggcuccagcaagauccgguggaucgucgagcgcgggauggugaagcccaagggcaagguggucgaccuggggugcggccgcggcggguggagcuacuacauggccacccucaagaacgugaccgaggugaagggcuacacgaaggggggcccggggcacgaggagcccauccccauggccaccuacggcuggaaccuggucaagcugcacuccggcguggacguguucuacaagcccaccgagcaggucgacacccuccugugcgacaucggggagagcuccagcaacccgacgaucgaggagggccggacccugcgcgugcucaagaugguggagcccuggcuguccagcaagcccgaguucugcaucaagguccugaaccccuacaugccgaccgugaucgaggagcuggagaagcuccagcggaagcacgggggcaaccugguccgcugcccccugucccggaacagcacccacgagauguacuggguguccggcgccagcgggaacaucguguccagcgucaacacgaccuccaagaugcuccugaaccgcuucaccacccggcaccgcaagcccacguacgagaaggacguggaccugggcgcggggacccggagcguguccaccgagaccgagaagcccgacaugacgaucaucggccgccggcuccagcgccugcaggaggagcacaaggagaccuggcacuacgaccaggagaacccguaccggaccugggccuaccacgggagcuacgaggcccccuccaccggcagcgccuccagcauggucaacggcguggugaagcugcucacgaagcccugggacgucaucccgauggugacccagcuggccaugaccgacaccacgcccuucgggcagcagcgcguguucaaggagaaggucgacacccggaccccccagcccaagccgggcacccgcauggugaugacgaccaccgcgaacuggcugugggcccuccuggggaagaagaagaacccccggcugugcacccgcgaggaguucaucagcaaggugcgguccaacgccgccaucggcgccgucuuccaggaggagcagggguggacgagcgcguccgaggccgugaacgacagccgcuucugggagcucguggacaaggagcgggcccugcaccaggagggcaagugcgaguccugcgucuacaacaugaugggcaagcgcgagaagaagcugggggaguucggccgcgccaaggggagccgggccaucugguacauguggcucggcgcgcgcuuccuggaguucgaggcccugggguuccucaacgaggaccacugguucggccgggagaacuccuggagcggcguggagggggagggccugcaccgccugggguacauccucgaggagaucgacaagaaggacggcgaccugauguacgccgacgacaccgccggcugggacacccggaucaccgaggacgaccugcagaacgaggagcucaucacggagcagauggcgccccaccacaagauccuggccaaggccaucuucaagcugaccuaccagaacaagguggucaaggugcuccgccccaccccgcggggggccgugauggacaucaucucccgcaaggaccagcggggcagcgggcaggucggcaccuacgggcugaacaccuucacgaacauggaggugcagcugauccgccagauggaggccgagggcgugaucacccaggacgacaugcagaaccccaagggccucaaggagcgggucgagaaguggcugcgcgagugcgggguggaccggcugaagcgcauggcgaucuccggcgacgacugcguggucaagccccucgacgagcgguucgggaccagccugcuguuccucaacgacaugggcaaggugcgcaaggacaucccccagugggagccguccaagggguggaagaacuggcaggaggugcccuucugcagccaccacuuccacaagaucuucaugaaggacggccggucccuggucgugcccugccgcaaccaggacgagcugaucggccgggcccgcaucagccagggggccggcuggucccuccgcgagaccgccugccuggggaaggccuacgcgcagauguggagccugauguacuuccaccggcgcgaccuccggcuggccagcauggccaucugcuccgccgugcccacggagugguucccgaccagccgcaccaccugguccauccacgcccaccaccaguggaugacgaccgaggacaugcugaaggucuggaaccggguguggaucgaggacaaccccaacaugaucgacaagacccccgugcacagcugggaggacauccccuaccucggcaagcgcgaggaccuguggugcgggucccugaucggccucagcucccgggcgaccugggccaagaacauccacacggccaucacccagguccgcaaccugaucggcaaggaggaguacguggacuacaugccggugaugaagcgguacagcgcccccuccgagagcgaggggguccuguga

SEQ ID NO: 10448 - RNA, 9867 nt, Artificial Sequence
  derived and/or modified CDS sequence (opt1) from DENV-4__FJ882595__SS-prME
agcaccaucacccugcucugccugauccccacggccauggccuuccaccuguccacccgcgacggcgagccgcucaugaucguggcgaagcacgagcgggggcgcccccugcuguucaagaccaccgagggcaucaacaagugcacgcucaucgccauggaccugggggagaugugcgaggacaccgucaccuacaagugcccccugcucgugaacaccgagcccgaggacaucgacugcuggugcaaccugacgagcaccugggugauguacggcaccugcacccaguccggggagcggcgccgggagaagcgcagcgucgcccugacgccgcacuccggcaugggccucgagacccgggccgagaccuggaugagcuccgagggggccuggaagcacgcgcagcgcguggagagcuggauccugcggaaccccggcuucgcccugcucgccggguucauggccuacaugaucggccagaccgggauccagcgcacgguguucuucguccugaugaugcugguggcgcccuccuacggcaugcggugcgugggcgucgggaaccgcgacuucguggagggcgugagcgggggcgccugggucgaccucgugcuggagcacggcgggugcgugaccaccauggcccagggcaagcccacccuggacuucgagcucacgaagaccaccgccaaggaggucgcccugcugcggaccuacugcaucgaggcguccaucagcaacaucacgaccgccacccgcugcccgacccagggggagcccuaccucaaggaggagcaggaccagcaguacaucugccggcgcgacgugguggaccggggcugggggaacggcugcggccuguucgggaagggcggggucgugacgugcgccaaguucuccugcagcggcaagaucaccgggaaccuggugcagaucgagaaccucgaguacaccgucguggugaccguccacaacggcgacacgcacgccgugggcaacgacaccuccaaccacggggucaccgccaccaucacgccccgcagccccuccguggaggugaagcugccggacuacggcgagcugacccucgacugcgagccccggagcgggaucgacuucaacgagaugauccugaugaagaugaagaagaagaccuggcugguccacaagcagugguuccucgaccugccccugcccuggaccgcgggcgccgacaccuccgaggugcacuggaacuacaaggagcgcauggugacguucaaggucccgcacgccaagcggcaggacgugaccgugcucgggagccaggagggcgccaugcacagcgcccuggcgggcgccaccgaggucgacuccggggacggcaaccacauguucgccgggcaccugaagugcaaggugcgcauggagaagcuccgcaucaagggcaugagcuacaccaugugcuccggcaaguucagcaucgacaaggagauggccgagacgcagcacgggaccaccguggucaaggugaaguacgagggcgccggggcgcccugcaaggugcccaucgagauccgggacgucaacaaggagaagguggugggccgcgucaucuccagcaccccccuggccgagaacacgaacuccgugaccaacaucgagcuggagccgcccuucggggacagcuacaucgugaucggcgucggcaacuccgcccucacccugcacugguuccggaaggggagcuccaucggcaagauguucgagagcaccuaccgcggggccaagcggauggcgauccugggcgagacggccugggacuucggguccgugggcggccucuucaccagccuggggaaggccgugcaccaggucuucggcuccguguacaccaccauguucgggggcgugagcuggaugauccgcauccugaucggguuccucguccuguggaucggcacgaacucccggaacaccagcauggccaugaccugcaucgccgugggcgggaucacccuguuccugggcuucacggugcaggcggacauggggugcgucguguccuggagcggccgcgagcucaagugcgggagcggcaucuucguggucgacaacgugcacaccuggaccgagcaguacaaguuccagcccgagucccccgcccggcuggccagcgccauccugaacgcccacaaggacggcgugugcgggauccgcuccaccacgcggcucgagaacgucauguggaagcagaucaccaacgagcugaacuacgugcugugggagggcgggcacgaccucaccguggucgcgggcgacgugaagggcgugcugaccaaggggaagcgcgcccugacgccgcccgucagcgaccucaaguacuccuggaagaccuggggcaaggccaagaucuucacccccgaggcccggaacagcaccuuccugaucgacgggcccgacacguccgagugcccgaacgagcgccgggccuggaacagccuggagguggaggacuacggcuucgggauguucaccaccaacaucuggaugaaguuccgcgagggcuccagcgaggugugcgaccaccggcucauguccgcggccaucaaggaccagaaggccguccacgccgacaugggcuacuggaucgagagcuccaagaaccagaccuggcagaucgagaaggcgagccugaucgaggugaagacgugccuguggcccaagacccacacccucugguccaacggggugcuggagagccagaugcugauccccaaguccuacgccggcccguucagccagcacaacuaccgccagggguacgccacccagaccgucggccccuggcaccucgggaagcuggagaucgacuucggcgagugccccggcacgaccgugaccauccaggaggacugcgaccaccgggggcccagccugcgcaccacgaccgccuccggcaagcucgugacccaguggugcugccgcagcugcaccaugccgccccugcgguuccugggggaggacggcugcugguacgggauggagauccgcccccucuccgagaaggaggagaacauggucaagagccagguggccgcgggccagggcacguccgagaccuucagcauggggcugcugugccucacccuguucgucgaggagugccugcggcgccgggugacccgcaagcacaugauccucgccguggucaucacgcugugcgccaucauccugggcgggcucaccuggauggaccugcugcgggcccucaucaugcugggcgacaccauguccggccgcaucgggggccagacccaccuggccaucauggcgguguucaagaugagccccggguacgugcucggcgucuuccugcggaagcugacgucccgcgagaccgcccucauggugaucgggauggccaugaccaccacgcugagcaucccgcacgaccugauggagcucaucgacggcaucucccugggccugauccuccugaagaucgugacccaguucgacaacacccaggucgggacccuggcccucagccugacguucauccgguccaccaugagccuggugauggccuggcgcaccaucauggcggugcucuucgucgugacccugaucccccugugccggacguccugccuccagaagcagagccacuggguggagaucaccgcccugauccugggcgcccaggcccuccccgucuaccugaugacccugaugaagggggcgucccgccggagcuggccccucaacgagggcaucauggccguggggcuggugucccugcucggcagcgcccugcugaagaacgacgucccgcucgccggccccaugguggccgggggccugcugcucgcggccuacgugaugagcggguccagcgccgaccugucccuggagaaggccgccaacguccagugggacgagauggcggacaucaccggcagcucccccaucaucgaggugaagcaggacgaggacgggagcuucuccauccgcgacguggaggagacgaacaugaucacccuccuggucaagcuggcccucaucaccgugagcggccuguacccccuggccaucccggugaccaugacgcucugguacauguggcaggucaagacccagcgguccggcgcccugugggacgugcccagccccgccgcgacccagaaggccgcccuguccgaggggguguaccgcaucaugcagcggggccucuucgggaagacccaggucggcguggggauccacauggagggcguguuccacaccauguggcacgucacgcgcggcagcgugaucugccacgagaccgggcggcuggagcccuccugggccgacgugcgcaacgacaugaucagcuacggcgggggcuggcgccugggcgacaagugggacaaggaggaggacguccaggugcucgccaucgagccggggaagaaccccaagcacgugcagaccaagcccggccuguucaagacccugacgggggagaucggcgcggucacccucgacuucaagcccgggaccuccggcagcccgaucaucaaccggaagggcaaggugaucgggcuguacggcaacgggguggucaccaaguccggcgacuacgugagcgccaucacgcaggccgagcgcaucggggagcccgacuacgagguggacgaggacaucuuccggaagaagcgccugaccaucauggaccuccaccccggcgccggcaagaccaagcggauccugccguccaucguccgcgaggcgcugaagcggcgccugcggacccucauccuggcccccacgcgcgugguggccgccgagauggaggaggcccugcgggggcuccccauccgcuaccagacccccgcggucaagagcgagcacaccggccgggagaucguggaccugaugugccacgccaccuucacgacccgccugcucagcuccacccgggugccgaacuacaaccugaucgucauggacgaggcccacuucaccgaccccagcuccguggccgcccgcggguacaucagcacgcgggucgagaugggcgaggcggccgccaucuucaugaccgccaccccccccggggccaccgacccguucccccaguccaacagccccaucgaggacaucgagcgcgagauccccgagcgguccuggaacacgggcuucgacuggaucaccgacuaccagggcaagaccgugugguucgugccgagcaucaaggcggggaacgacaucgccaacugccugcgcaaguccggcaagaaggucauccagcucagccgcaagaccuucgacacggaguaccccaagaccaagcugaccgacugggacuucguggugaccacggacaucuccgagaugggggccaacuuccgggccggccgcgucaucgacccccggcgcugccugaagcccgugauccucaccgacgggccggagcgggugauccuggcgggccccauccccgucacccccgccagcgccgcccagcgccggggccgcaucgggcggaacccggcccaggaggacgaccaguacguguucuccggcgacccccugaagaacgacgaggaccacgcgcacuggaccgaggccaagaugcuccuggacaacaucuacacgcccgaggggaucauccccacccuguucggcccggagcgcgagaagacccaggccaucgacggcgaguuccggcuccgcggggagcagcggaagaccuucguggagcugaugcgccggggcgaccugcccgucuggcucagcuacaagguggccuccgccgggaucagcuacaaggaccgcgaguggugcuucacgggcgagcggaacaaccagauccuggaggagaacauggagguggagaucuggacccgcgagggggagaagaagaagcugcggccccgcuggcucgacgcgcgggucuacgccgaccccauggcccugaaggacuucaaggaguucgccuccggccgcaagagcaucacccuggacauccucaccgagaucgccucccugccgaccuaccugagcagccgcgcgaagcucgcccuggacaacaucgugaugcugcacacgaccgagcggggcgggcgcgccuaccagcacgcccucaacgagcugcccgagucccuggagacccucaugcugguggcgcugcucggcgccaugaccgccgggaucuuccuguucuucaugcagggcacggggaucggcaagcugagcaugggccucaucaccaucgccgucgccuccgggcugcuguggguggcggagauccagccccaguggaucgccgccagcaucauccucgaguucuuccugauggugcugcucaucccggagcccgagaagcagcggaccccccaggacaaccagcugaucuacgucauccugaccauccucacgaucaucggccugaucgccgccaacgagauggggcugaucgagaagaccaagaccgacuucggcuucuaccaggugaagaccgagacgaccauccucgacguggaccugcgccccgcguccgccuggacccuguacgccgucgccaccacgauccucaccccgaugcugcggcacaccaucgagaacaccagcgccaaccugucccucgcggccaucgccaaccaggccgccgugcugauggggcugggcaagggcuggccccuccaccgcauggaccugggggugccccugcucgcgaugggcugcuacagccaggucaaccccacgacccugaccgccucccuggugaugcuccuggugcacuacgccaucaucgggccgggccugcaggccaaggcgacccgggaggcccagaagcgcacggccgccggcaucaugaagaaccccaccgucgacgggaucaccgugaucgaccucgagcccaucagcuacgaccccaaguucgagaagcagcugggccaggugaugcugcucguccugugcgccgggcagcugcuccugaugcggaccacgugggcguucugcgaggugcugacccucgccaccggcccgauccugacccugugggaggggaaccccggccgcuucuggaacacgaccaucgccguguccaccgccaacaucuuccggggcagcuaccucgccggggcgggccuggccuucucccugaucaagaacgcccagaccccccgccgggggacgggcaccaccggggagacccucggcgagaaguggaagcgccagcugaacagccuggaccggaaggaguucgaggaguacaagcgcuccggcauccucgaggucgaccggaccgaggccaagagcgcccugaaggacggguccaagaucaagcacgcggugagccgcggcuccagcaagauccgguggaucguggagcgcgggauggucaagcccaagggcaaggugguggaccuggggugcggccgcggcggguggagcuacuacauggccacgcucaagaacgucaccgaggugaagggcuacaccaaggggggcccggggcacgaggagcccauccccauggccaccuacggcuggaaccuggugaagcugcacuccggcgucgacguguucuacaagcccacggagcagguggacacccuccugugcgacaucggggagagcuccagcaacccgaccaucgaggagggccggacccugcgcguccucaagaugguggagcccuggcuguccagcaagcccgaguucugcaucaaggugcugaaccccuacaugccgacggucaucgaggagcuggagaagcuccagcggaagcacgggggcaaccuggugcgcugcccccugucccggaacagcacccacgagauguacugggucuccggcgccagcgggaacaucguguccagcgugaacaccaccuccaagaugcuccugaaccgcuucacgacccggcaccgcaagcccaccuacgagaaggacgucgaccugggcgcggggacccggagcguguccacggagaccgagaagcccgacaugaccaucaucggccgccggcuccagcgccugcaggaggagcacaaggagaccuggcacuacgaccaggagaacccguaccggacgugggccuaccacgggagcuacgaggcccccuccaccggcagcgccuccagcauggugaacggcgucgugaagcugcucaccaagcccugggacgugaucccgauggucacccagcuggccaugacggacaccacccccuucgggcagcagcgcguguucaaggagaagguggacacccggacgccccagcccaagccgggcacccgcauggucaugaccaccacggcgaacuggcugugggcccuccuggggaagaagaagaacccccggcugugcacccgcgaggaguucaucagcaaggugcgguccaacgccgccaucggcgccguguuccaggaggagcagggguggaccagcgcguccgaggccgucaacgacagccgcuucugggagcucguggacaaggagcgggcccugcaccaggagggcaagugcgaguccugcguguacaacaugaugggcaagcgcgagaagaagcugggggaguucggccgcgccaaggggagccgggccaucugguacauguggcucggcgcgcgcuuccuggaguucgaggcccugggguuccucaacgaggaccacugguucggccgggagaacuccuggagcggcgucgagggggagggccugcaccgccugggguacauccucgaggagaucgacaagaaggacggcgaccugauguacgccgacgacaccgccggcugggacacgcggaucaccgaggacgaccugcagaacgaggagcucaucaccgagcagauggcgccccaccacaagauccuggccaaggccaucuucaagcugaccuaccagaacaagguggugaagguccuccgccccaccccgcggggggccgugauggacaucaucucccgcaaggaccagcggggcagcgggcaggugggcacguacgggcugaacaccuucaccaacauggagguccagcugauccgccagauggaggccgagggcgugaucacccaggacgacaugcagaaccccaagggccucaaggagcggguggagaaguggcugcgcgagugcggggucgaccggcugaagcgcauggcgaucuccggcgacgacugcguggugaagccccucgacgagcgguucgggacgagccugcuguuccucaacgacaugggcaagguccgcaaggacaucccccagugggagccguccaagggguggaagaacuggcaggaggugcccuucugcagccaccacuuccacaagaucuucaugaaggacggccggucccuggugguccccugccgcaaccaggacgagcugaucggccgggcccgcaucagccagggggccggcuggucccuccgcgagaccgccugccuggggaaggccuacgcgcagauguggagccugauguacuuccaccggcgcgaccuccggcuggccagcauggccaucugcuccgccgugcccaccgagugguucccgaccagccgcacgaccugguccauccacgcccaccaccaguggaugaccaccgaggacaugcugaagguguggaaccgggucuggaucgaggacaaccccaacaugaucgacaagacgcccgugcacagcugggaggacauccccuaccucggcaagcgcgaggaccuguggugcgggucccugaucggccucagcucccgggcgaccugggccaagaacauccacaccgccaucacccaggugcgcaaccugaucggcaaggaggaguacgucgacuacaugccggugaugaagcgguacagcgcccccuccgagagcgagggggugcuguga

SEQ ID NO: 10449 - RNA, 9867 nt, Artificial Sequence
  derived and/or modified CDS sequence (opt1) from DENV-4__FJ882596__SS-prME
agcaccaucacccugcucugccugauccccacggugauggccuuccaccuguccacccgcgacggcgagccgcucaugaucgucgccaagcacgagcgggggcgcccccugcuguucaagaccaccgagggcaucaacaagugcacgcucaucgcgauggaccugggggagaugugcgaggacaccgugaccuacaagugcccccugcucgugaacaccgagcccgaggacaucgacugcuggugcaaccugacgagcaccugggucauguacggcaccugcacccaguccggggagcggcgccgggagaagcgcagcguggcccugacgccgcacuccggcaugggccucgagacccgggccgagaccuggaugagcuccgagggggccuggaagcacgcccagcgcguggagagcuggauccugcggaaccccggcuucgcgcugcucgccggguucauggccuacaugaucggccagaccgggauccagcgcacggucuucuucgugcugaugaugcugguggcccccuccuacggcaugcggugcgucggcguggggaaccgcgacuucguggagggcgucagcgggggcgcguggguggaccucgugcuggagcacggcgggugcgucaccaccauggcccagggcaagcccacccuggacuucgagcucacgaagaccaccgccaaggagguggcccugcugcggaccuacugcaucgaggccuccaucagcaacaucacgaccgcgacccgcugcccgacccagggggagcccuaccucaaggaggagcaggaccagcaguacaucugccggcgcgacguggucgaccggggcugggggaacggcugcggccuguucgggaagggcgggguggugacgugcgccaaguucuccugcagcggcaagaucaccgggaaccugguccagaucgagaaccucgaguacaccgugguggucaccgugcacaacggcgacacgcacgccgucggcaacgacaccuccaaccacggggugaccgccaccaucacgccccgcagccccuccguggaggucaagcugccggacuacggcgagcugacccucgacugcgagccccggagcgggaucgacuucaacgagaugauccugaugaagaugaagaagaagaccuggcuggugcacaagcagugguuccucgaccugccccugcccuggaccgccggcgcggacaccuccgaggugcacuggaacuacaaggagcgcauggucacguucaaggugccgcacgccaagcggcaggacgugaccguccucgggagccaggagggcgccaugcacagcgcccuggccggcgcgaccgagguggacuccggggacggcaaccacauguucgccgggcaccugaagugcaaggugcgcauggagaagcuccgcaucaagggcaugagcuacaccaugugcuccggcaaguucagcaucgacaaggagauggccgagacgcagcacgggaccaccgucgugaaggugaaguacgagggcgccggggcccccugcaagguccccaucgagauccgggacgugaacaaggagaagguggucggccgcgugaucuccagcaccccccuggcggagaacacgaacuccgugaccaacaucgagcuggagccgcccuucggggacagcuacaucgucaucggcgugggcaacuccgcccucacccugcacugguuccggaaggggagcuccaucggcaagauguucgagagcaccuaccgcggggccaagcggauggccauccugggcgagacggcgugggacuucggguccgugggcggccucuucaccagccuggggaaggccguccaccagguguucggcuccguguacaccaccauguucgggggcgucagcuggaugauccgcauccugaucggguuccucgugcuguggaucggcacgaacucccggaacaccagcauggccaugaccugcaucgccgugggcgggaucacccuguuccugggcuucacgguccaggccgacauggggugcgugguguccuggagcggccgcgagcucaagugcgggagcggcaucuucgucguggacaacgugcacaccuggaccgagcaguacaaguuccagcccgagucccccgcgcggcuggccagcgccauccugaacgcccacaaggacggcgucugcgggauccgcuccaccacgcggcucgagaacgugauguggaagcagaucaccaacgagcugaacuacgugcugugggagggcgggcacgaccucaccgucguggccggcgacgugcgcggcguccugaccaaggggaagcgggcgcugacgccgcccgugagcgaccucaaguacuccuggaagaccuggggcaaggccaagaucuucacccccgaggcccgcaacagcaccuuccugaucgacgggcccgacacguccgagugcccgaacgagcggcgcgccuggaacagccuggagguggaggacuacggcuucgggauguucaccaccaacaucuggaugaaguuccgggagggcuccagcgaggucugcgaccaccgccucauguccgccgcgaucaaggaccagaaggccgugcacgccgacaugggcuacuggaucgagagcuccaagaaccagaccuggcagaucgagaaggccagccugaucgaggugaagacgugccuguggcccaagacccacacccucugguccaacgggguccuggagagccagaugcugauccccaaguccuacgcgggcccguucagccagcacaacuaccggcagggguacgccacccagaccgugggccccuggcaccucgggaagcuggagaucgacuucggcgagugccccggcacgaccgugaccauccaggaggacugcgaccaccgcgggcccagccugcgcaccacgaccgccuccggcaagcucgucacccaguggugcugccggagcugcaccaugccgccccugcgcuuccugggggaggacggcugcugguacgggauggagauccggccccucuccgagaaggaggagaacauggugaagagccaggucgccgccggccagggcacguccgagaccuucagcauggggcugcugugccucacccuguucguggaggagugccugcgccggcgcgugacccggaagcacaugauccucgcggucgugaucacgcugugcgccaucauccugggcgggcucaccuggauggaccugcugcgcgcccucaucaugcugggcgacaccauguccggccggaucgggggccagacccaccuggccaucauggccguguucaagaugagccccggguacguccucggcguguuccugcgcaagcugacgucccgggagaccgcgcucauggugaucgggauggccaugaccaccacgcugagcaucccgcacgaccugauggagcucaucgacggcaucucccugggccugauccuccugaagaucgucacccaguucgacaacacccagguggggacccuggcccucagccugacguucauccgcuccaccaugagccuggugauggccuggcggaccaucauggccguccucuucguggugacccugaucccccugugccgcacguccugccuccagaagcagagccacugggucgagaucaccgcgcugauccugggcgcccaggcccuccccguguaccugaugacccugaugaagggggccucccggcgcagcuggccccucaacgagggcaucauggcgguggggcuggucucccugcucggcagcgcccugcugaagaacgacgugccgcucgccggccccaugguggccgggggccugcugcucgccgcguacgucaugagcggguccagcgccgaccugucccuggagaaggccgccaacgugcagugggacgagauggccgacaucaccggcagcucccccaucaucgaggugaagcaggacgaggacgggagcuucuccauccgggacgucgaggagacgaacaugaucacccuccuggugaagcuggcgcucaucaccgugagcggccuguacccccuggccaucccggucaccaugacgcucugguacauguggcaggugaagacccagcgcuccggcgcccugugggacgugcccagccccgccgccacccagaaggcggcccuguccgagggggucuaccggaucaugcagcgcggccucuucgggaagacccaggugggcguggggauccacauggagggcgucuuccacaccauguggcacgugacgcggggcagcgugaucugccacgagaccgggcgccuggagcccuccugggccgacguccgcaacgacaugaucagcuacggcgggggcuggcggcugggcgacaagugggacaaggaggaggacgugcaggugcucgccaucgagccggggaagaaccccaagcacguccagaccaagcccggccuguucaagacccugacgggggagaucggcgccgugacccucgacuucaagcccgggaccuccggcagcccgaucaucaaccgcaagggcaaggugaucgggcuguacggcaacggggucgugaccaaguccggcgacuacgugagcgcgaucacgcaggccgagcggaucggggagcccgacuacgaggucgacgaggacaucuuccgcaagaagcggcugaccaucauggaccuccaccccggcgccggcaagaccaagcgcauccugccguccaucgugcgggaggcccugaagcgccggcugcgcacccucauccuggcgcccacgcggguggucgccgccgagauggaggaggcccugcgcgggcuccccauccgguaccagacccccgccgugaagagcgagcacaccggccgcgagaucguggaccugaugugccacgcgaccuucacgacccggcugcucagcuccacccgcgucccgaacuacaaccugaucgugauggacgaggcccacuucaccgaccccagcuccgucgccgcccggggguacaucagcacgcgcguggagaugggcgaggccgcggccaucuucaugaccgccaccccccccggggccaccgacccguucccccaguccaacagccccaucgaggacaucgagcgggagauccccgagcgcuccuggaacacgggcuucgacuggaucaccgacuaccagggcaagaccgugugguucgucccgagcaucaaggccgggaacgacaucgcgaacugccugcgcaaguccggcaagaaggugauccagcucagccggaagaccuucgacacggaguaccccaagaccaagcugaccgacugggacuucguggucaccacggacaucuccgagaugggggccaacuuccgcgccggccgggugaucgacccccgccggugccugaagcccgugauccucaccgacgggccggagcgcgucauccuggccggccccauccccgugacccccgcgagcgccgcccagcggcgcggccggaucgggcgcaacccggcccaggaggacgaccaguacguguucuccggcgacccccugaagaacgacgaggaccacgcccacuggaccgaggcgaagaugcuccuggacaacaucuacacgcccgaggggaucauccccacccuguucggcccggagcgggagaagacccaggccaucgacggcgaguuccgccuccggggggagcagcgcaagaccuucgucgagcugaugcggcgcggcgaccugcccguguggcucagcuacaagguggccuccgccgggaucagcuacaaggaccgggaguggugcuucacgggcgagcgcaacaaccagauccuggaggagaacauggaggucgagaucuggacccgggagggggagaagaagaagcugcgcccccgguggcucgacgcccgcguguacgcggaccccauggcccugaaggacuucaaggaguucgccuccggccgcaagagcaucacccuggacauccucaccgagaucgccucccugccgaccuaccugagcagccgggccaagcucgcgcuggacaacaucgugaugcugcacacgaccgagcgcggcgggcgggccuaccagcacgcccucaacgagcugcccgagucccuggagacccucaugcuggucgcccugcucggcgcgaugaccgccgggaucuuccuguucuucaugcagggcaaggggaucggcaagcugagcaugggccucaucacgaucgccguggccuccgggcugcuguggguggccgagauccagccccaguggaucgcggccagcaucauccucgaguucuuccugaugguccugcucaucccggagcccgagaagcagcgcaccccccaggacaaccagcugaucuacgugauccugaccauccucaccaucaucggccugaucgccgccaacgagauggggcugaucgagaagacgaagaccgacuucggcuucuaccaggugaagaccgagaccacgauccucgacgucgaccugcggcccgccuccgcguggacccuguacgccguggccaccaccauccucacgccgaugcugcgccacaccaucgagaacaccagcgccaaccugucccucgccgcgaucgccaaccaggccgccgugcugauggggcugggcaagggcuggccccuccaccggauggaccugggggucccccugcucgccaugggcugcuacagccaggugaaccccaccacgcugaccgcgucccuggugaugcuccugguccacuacgccaucaucgggccgggccugcaggccaaggccacccgcgaggcgcagaagcggaccgccgccggcaucaugaagaaccccacgguggacgggaucaccgugaucgaccucgagcccaucagcuacgaccccaaguucgagaagcagcugggccaggucaugcugcucgugcugugcgccgggcagcugcuccugaugcgcaccaccugggccuucugcgaggugcugacgcucgcgaccggcccgauccugacccugugggaggggaaccccggccgguucuggaacaccacgaucgccgucuccaccgccaacaucuuccgcggcagcuaccucgccggggccggccuggcguucucccugaucaagaacgcccagaccccccggcgcgggaccggcacgaccggggagacccucggcgagaaguggaagcggcagcugaacagccuggaccgcaaggaguucgaggaguacaagcgguccggcauccucgagguggaccgcaccgaggccaagagcgcccugaaggacggguccaagaucaagcacgccgugagccggggcuccagcaagauccgcuggaucgucgagcgcgggauggugaagcccaagggcaagguggucgaccuggggugcggccggggcggguggagcuacuacauggcgacccucaagaacgugacggaggugaagggcuacaccaaggggggcccggggcacgaggagcccauccccauggccaccuacggcuggaaccuggucaagcugcacuccggcguggacguguucuacaagcccaccgagcaggucgacacgcuccugugcgacaucggggagagcuccagcaacccgaccaucgaggagggccgcacccugcgggugcucaagaugguggagcccuggcuguccagcaagcccgaguucugcaucaagguccugaaccccuacaugccgaccgugaucgaggagcuggagaagcuccagcgcaagcacgggggcaaccugguccggugcccccugucccgcaacagcacgcacgagauguacuggguguccggcgccagcgggaacaucguguccagcgucaacaccaccuccaagaugcuccugaaccgguucaccacgcgccaccggaagcccaccuacgagaaggacguggaccugggcgccgggacccgcagcguguccaccgagacggagaagcccgacaugaccaucaucggccggcgccuccagcggcugcaggaggagcacaaggagaccuggcacuacgaccaggagaacccguaccgcaccugggcguaccacgggagcuacgaggcccccuccacgggcagcgccuccagcauggucaacggcguggugaagcugcucaccaagcccugggacgucaucccgauggugacccagcuggccaugaccgacacgacccccuucgggcagcagcggguguucaaggagaaggucgacacccgcaccccccagcccaagccgggcacgcggauggugaugaccaccaccgccaacuggcugugggcgcuccuggggaagaagaagaacccccgccugugcacgcgggaggaguucaucagcaaggugcgcuccaacgccgccaucggcgccgucuuccaggaggagcagggguggaccagcgccuccgaggcggugaacgacagccgguucugggagcucguggacaaggagcgcgcccugcaccaggagggcaagugcgaguccugcgucuacaacaugaugggcaagcgcgagaagaagcugggggaguucggccgggccaaggggagccgcgccaucugguacauguggcucggcgcccgguuccuggaguucgaggcgcugggguuccucaacgaggaccacugguucggccgcgagaacuccuggagcggcguggagggggagggccugcaccggcugggguacauccucgaggagaucgacaagaaggacggcgaccugauguacgccgacgacaccgccggcugggacacccgcaucacggaggacgaccugcagaacgaggagcucaucaccgagcagauggccccccaccacaagauccuggcgaaggccaucuucaagcugaccuaccagaacaagguggucaaggugcuccggcccaccccgcgcggggccgugauggacaucaucucccggaaggaccagcgcggcagcgggcaggucggcaccuacgggcugaacacguucaccaacauggaggugcagcugauccggcagauggaggccgagggcgugaucacccaggacgacaugcagaaccccaagggccucaaggagcgcgucgagaaguggcugcgggagugcgggguggaccgccugaagcggauggccaucuccggcgacgacugcguggucaagccccucgacgagcgcuucgggaccagccugcuguuccucaacgacaugggcaaggugcggaaggacaucccccagugggagccguccaagggguggaagaacuggcaggaggugcccuucugcagccaccacuuccacaagaucuucaugaaggacggccgcucccuggucgugcccugccggaaccaggacgagcugaucggccgcgcgcgcaucagccagggggccggcuggucccuccgggagacggccugccuggggaaggccuacgcccagauguggagccugauguacuuccaccgccgggaccuccgccuggcgagcauggccaucugcuccgccgugcccaccgagugguucccgaccagccggaccacgugguccauccacgcccaccaccaguggaugaccaccgaggacaugcugaaggucuggaaccgcguguggaucgaggacaaccccaacaugaucgacaagacccccgugcacagcugggaggacauccccuaccucggcaagcgggaggaccuguggugcgggucccugaucggccucagcucccgcgccacgugggcgaagaacauccacaccgccaucacccagguccggaaccugaucggcaaggaggaguacguggacuacaugccggugaugaagcgcuacagcgcccccuccgagagcgaggggguccuguga

SEQ ID NO: 10450 - RNA, 9867 nt, Artificial Sequence
  derived and/or modified CDS sequence (opt1) from DENV-4__FJ850059__SS-prME
agcaccaucacccugcucugccugauccccacggugauggccuuccaccuguccacccgcgacggcgagccgcucaugaucgucgccaagcacgagcgggggcgcccccugcuguucaagaccaccgagggcaucaacaagugcacgcucaucgcgauggaccugggggagaugugcgaggacaccgugaccuacaagugcccccugcucgugaacaccgagcccgaggacaucgacugcuggugcaaccugacgagcaccugggucauguacggcaccugcacccaguccggggagcggcgccgggagaagcgcagcguggcccugacgccgcacuccggcaugggccucgagacccgggccgagaccuggaugagcuccgagggggccuggaagcacgcccagcgcguggagagcuggauccugcggaaccccggcuucgcgcugcucgccggguucauggccuacaugaucggccagaccgggauccagcgcacggucuucuucgugcugaugaugcugguggcccccuccuacggcaugcggugcgucggcguggggaaccgcgacuucguggagggcgucagcgggggcguguggguggaccucguccuggagcacggcgggugcgugaccaccauggcgcagggcaagcccacccuggacuucgagcucacgaagaccaccgccaaggagguggcccugcugcggaccuacugcaucgaggccuccaucagcaacaucacgaccgccacccgcugcccgacccagggggagcccuaccucaaggaggagcaggaccagcaguacaucugccggcgcgacgucguggaccggggcugggggaacggcugcggccuguucgggaagggcgggguggucacgugcgcgaaguucuccugcagcggcaagaucaccgggaaccuggugcagaucgagaaccucgaguacaccguggucgugaccguccacaacggcgacacgcacgccgugggcaacgacaccuccaaccacggggugaccgccaccaucacgccccgcagccccuccgucgaggugaagcugccggacuacggcgagcugacccucgacugcgagccccggagcgggaucgacuucaacgagaugauccugaugaagaugaagaagaagaccuggcuggugcacaagcagugguuccucgaccugccccugcccuggaccgccggcgccgacaccuccgagguccacuggaacuacaaggagcgcauggugacguucaaggugccgcacgcgaagcggcaggacgucaccgugcucgggagccaggagggcgccaugcacagcgcccuggccggcgccaccgagguggacuccggggacggcaaccacauguucgcggggcaccugaagugcaagguccgcauggagaagcuccgcaucaagggcaugagcuacaccaugugcuccggcaaguucagcaucgacaaggagauggccgagacgcagcacgggaccaccguggugaaggucaaguacgagggcgccggggcccccugcaaggugcccaucgagauccgggacgugaacaaggagaaggucgugggccgcgugaucuccagcaccccccuggccgagaacacgaacuccgucaccaacaucgagcuggagccgcccuucggggacagcuacaucgugaucggcgugggcaacuccgcgcucacccugcacugguuccggaaggggagcuccaucggcaagauguucgagagcaccuaccgcggggccaagcggauggccauccugggcgagacggccugggacuucggguccgucggcggccucuucaccagccuggggaaggcggugcaccagguguucggcuccgucuacaccaccauguucgggggcgugagcuggaugauccgcauccugaucggguuccucgugcuguggaucggcacgaacucccggaacaccagcauggccaugaccugcaucgccgucggcgggaucacccuguuccugggcuucacggugcaggccgacauggggugcguggucuccuggagcggccgcgagcucaagugcgggagcggcaucuucgugguggacaacguccacaccuggaccgagcaguacaaguuccagcccgagucccccgcccggcuggcgagcgccauccugaucgcccacaaggacggcgugugcgggauccgcuccaccacgcggcucgagaacgugauguggaagcagaucaccaacgagcugaacuacguccugugggagggcgggcacgaccucaccgugguggccggcgacgccaagggcguccugaccaaggggaagcgcgcgcugacgccgcccgugagcgaccucaaguacuccuggaagaccuggggcaaggccaagaucuucacccccgaggcccggaacagcaccuuccugaucgacgggcccgacacguccgagugcccgaacgagcgccgggccuggaacagccuggagguggaggacuacggcuucgggauguucaccaccaacaucuggaugaaguuccgcgagggcuccagcgaggucugcgaccaccggcucauguccgccgcgaucaaggaccagaaggccgugcacgccgacaugggcuacuggaucgagagcuccaagaaccagaccuggcagaucgagaaggccagccugaucgaggugaagacgugccuguggcccaagacccacacccucugguccaacgggguccuggagagccagaugcugauccccaaguccuacgcgggcccguucagccagcacaacuaccgccagggguacgccacccagaccgugggccccuggcaccucgggaagcuggagaucgacuucggcgagugccccggcacgaccgugaccauccaggaggacugcgaccaccgggggcccagccugcgcaccacgaccgccuccggcaagcucgucacccaguggugcugccgcagcugcaccaugccgccccugcgguuccugggggaggacggcugcugguacgggauggagauccgcccccucuccgagaaggaggagaacauggugaagagccaggucacggccggccagggcaccuccgagaccuucagcauggggcugcugugccucacccuguucguggaggagugccugcggcgccgggugacgcgcaagcacaugauccucgccgucgugaucacccugugcgcgaucauccugggcgggcucaccuggauggaccugcugcgggcccucaucaugcugggcgacaccauguccggccgcaucgggggccagacgcaccuggccaucauggccguguucaagaugagccccggguacguccucggcguguuccugcggaagcugaccucccgcgagaccgcccucauggugaucgggauggcgaugaccacgacccugagcaucccgcacgaccugauggagcucaucgacggcaucucccugggccugauccuccugaagaucgucacccaguucgacaacacccagguggggacgcuggcccucagccugaccuucauccgguccaccaugagccuggugauggccuggcgcaccaucauggccguccucuucguggugacgcugaucccccugugccggaccuccugccuccagaagcagagccacugggucgagaucaccgcccugauccugggcgcgcaggcccuccccguguaccugaugacccugaugaagggggccucccgccggagcuggccccucaacgagggcaucauggccguggggcuggucucccugcucggcagcgcgcugcugaagaacgacgugccgcucgccggccccaugguggccgggggccugcugcucgccgccuacgucaugagcggguccagcgcggaccugucccuggagaaggccgccaacgugcagugggacgagauggccgacaucacgggcagcucccccaucaucgaggugaagcaggacgaggacgggagcuucuccauccgcgacgucgaggagaccaacaugaucacccuccuggugaagcuggcccucaucaccgugagcggccuguacccccuggcgaucccggucacgaugacccucugguacauguggcaggugaagacccagcgguccggcgcccugugggacgugcccagccccgccgccacccagaaggccgcgcuguccgagggggucuaccgcaucaugcagcggggccucuucgggaagacccaggugggcguggggauccacauggagggcgucuuccacacgauguggcacgugacccgcggcagcgugaucugccacgagaccgggcggcuggagcccuccugggccgacguccgcaacgacaugaucagcuacggcgggggcuggcgccugggcgacaagugggacaaggaggaggacgugcaggugcucgccaucgagccggggaagaaccccaagcacguccagaccaagcccggccuguucaagacgcugaccggggagaucggcgccgugacccucgacuucaagcccgggaccuccggcagcccgaucaucaaccggaagggcaaggugaucgggcuguacggcaacggggucgugacgaaguccggcgacuacgugagcgccaucacccaggcggagcgcaucggggagcccgacuacgaggucgacgaggacaucuuccggaagaagcgccugaccaucauggaccuccaccccggcgccggcaagaccaagcggauccugccguccaucgugcgcgaggcccugaagcggcgccugcggacgcucauccuggcccccacccgcguggucgcggccgagauggaggaggcccugcgggggcuccccauccgcuaccagacccccgccgugaagagcgagcacaccggccgggagaucguggaccugaugugccacgccacguucaccacccgccugcucagcuccacccgggucccgaacuacaaccugaucgugauggacgaggcgcacuucacggaccccagcuccgucgccgcccgcggguacaucagcacccggguggagaugggcgaggccgccgcgaucuucaugaccgccaccccccccggggccacggacccguucccccaguccaacagccccaucgaggacaucgagcgcgagauccccgagcgguccuggaacaccggcuucgacuggaucaccgacuaccagggcaagaccgugugguucgucccgagcaucaaggccgggaacgacaucgccaacugccugcgcaaguccggcaagaaggugauccagcucagccgcaagacguucgacaccgaguaccccaagaccaagcugaccgacugggacuucguggucacgaccgacaucuccgagaugggggcgaacuuccgggccggccgcgugaucgacccccggcgcugccugaagcccgugauccucaccgacgggccggagcgggucauccuggccggccccauccccgugacccccgccagcgcggcccagcgccggggccgcaucgggcggaacccggcccaggaggacgaccaguacguguucuccggcgacccccugaagaacgacgaggaccacgcccacuggacggaggccaagaugcuccuggacaacaucuacacccccgaggggaucauccccacccuguucggcccggagcgcgagaagacccaggcgaucgacggcgaguuccggcuccgcggggagcagcggaagacguucgucgagcugaugcgccggggcgaccugcccguguggcucagcuacaagguggccuccgccgggaucagcuacaaggaccgcgaguggugcuucaccggcgagcggaacaaccagauccuggaggagaacauggaggucgagaucuggacccgcgagggggagaagaagaagcugcggccccgcuggcucgacgcccggguguacgccgaccccauggcgcugaaggacuucaaggaguucgccuccggccgcaagagcaucacccuggacauccucaccgagaucgccucccugccgacguaccugagcagccgcgccaagcucgcccuggacaacaucgugaugcugcacaccaccgagcggggcgggcgcgcguaccagcacgcccucaacgagcugcccgagucccuggagacccucaugcuggucgcccugcucggcgccaugacggcggggaucuuccuguucuucaugcagggcaaggggaucggcaagcugagcaugggccucaucaccaucgccguggccuccgggcugcuguggguggccgagauccagccccaguggaucgccgcgagcaucauccucgaguucuuccugaugguccugcucaucccggagcccgagaagcagcggaccccccaggacaaccagcugaucuacgugauccugaccauccucacgaucaucggccugaucgccgccaacgagauggggcugaucgagaagaccaagaccgacuucggcuucuaccaggugaagaccgagacgaccauccucgacgucgaccugcgccccgccuccgccuggacccuguacgcgguggccaccacgauccucaccccgaugcugcggcacaccaucgagaacaccagcgccaaccugucccucgccgccaucgcgaaccaggccgccgugcugauggggcugggcaagggcuggccccuccaccgcauggaccugggggucccccugcucgccaugggcugcuacagccaggugaaccccacgacccugaccgccucccuggugaugcuccugguccacuacgcgaucaucgggccgggccugcaggccaaggccacccgggaggcccagaagcgcacggcggccggcaucaugaagaaccccaccguggacgggaucaccgugaucgaccucgagcccaucagcuacgaccccaaguucgagaagcagcugggccaggucaugcugcucgugcugugcgccgggcagcugcuccugaugcggaccacgugggccuucugcgaggugcugacccucgccaccggcccgauccugacccugugggaggggaaccccggccgcuucuggaacacgaccaucgcggucuccaccgccaacaucuuccggggcagcuaccucgccggggccggccuggccuucucccugaucaagaacgcgcagaccccccgccgggggacgggcaccaccggggagacccucggcgagaaguggaagcgccagcugaacagccuggaccggaaggaguucgaggaguacaagcgcuccggcauccucgagguggaccggaccgaggccaagagcgcccugaaggacggguccaagaucaagcacgccgugagccgcggcuccagcaagauccgguggaucgucgagcgcgggauggugaagcccaagggcaagguggucgaccuggggugcggccgcggcggguggagcuacuacauggccacgcucaagaacgugaccgaggugaagggcuacaccaaggggggcccggggcacgaggagcccauccccauggcgaccuacggcuggaaccuggucaagcugcacuccggcguggacguguucuaccggcccacggagcaggucgacacccuccugugcgacaucggggagagcuccagcaacccgaccaucgaggagggccgcacccugcgggugcucaagaugguggagcccuggcuguccagcaagcccgaguucugcaucaagguccugaaccccuacaugccgacggugaucgaggagcuggagaagcuccagcgcaagcacgggggcaaccugguccggugcccccugucccgcaacagcacccacgagauguacuggguguccggcgccagcgggaacaucguguccagcgucaacaccaccuccaagaugcuccugaaccgguucacgacccgccaccggaagcccaccuacgagaaggacguggaccugggcgccgggacccgcagcguguccacggagaccgagaagcccgacaugaccaucaucggccggcgccuccagcggcugcaggaggagcacaaggagaccuggcacuacgaccaggagaacccguaccgcacgugggccuaccacgggagcuacgaggcgcccuccaccggcagcgccuccagcauggucaacggcguggugaagcugcucaccaagcccugggacgucaucccgauggugacccagcuggccaugacggacaccacccccuucgggcagcagcggguguucaaggagaaggucgacacccgcacgccccagcccaagccgggcacccggauggugaugaccaccacggccaacuggcugugggcccuccuggggaagaagaagaacccccgccugugcacccgggaggaguucaucagcaaggugcgcuccaacgcggccaucggcgccgucuuccaggaggagcagggguggaccagcgccuccgaggccgugaacgacagccgguucugggagcucguggacaaggagcgcgcgcugcaccaggagggcaagugcgaguccugcgucuacaacaugaugggcaagcgcgagaagaagcugggggaguucggccgggccaaggggagccgcgccaucugguacauguggcucggcgcccgguuccuggaguucgaggcccugggguuccucaacgaggaccacugguucggccgcgagaacuccuggagcggcguggagggggagggccugcaccggcugggguacauccucgaggagaucgacaagaaggacggcgaccugauguacgcggacgacaccgccggcugggacacgcgcaucaccgaggacgaccugcagaacgaggagcucaucaccgagcagauggccccccaccacaagauccuggccaaggcgaucuucaagcugaccuaccagaacaagguggucaaggugcuccggcccaccccgcgcggggccgugauggacaucaucucccggaaggaccagcgcggcagcgggcaggucggcacguacgggcugaacaccuucaccaacauggaggugcagcugauccggcagauggaggccgagggcgugaucacccaggacgacaugcagaaccccaagggccucaaggagcgcgucgagaaguggcugcgggagugcgggguggaccgccugaagcggauggccaucuccggcgacgacugcguggucaagccccucgacgagcgcuucgggacgagccugcuguuccucaacgacaugggcaaggugcggaaggacaucccccagugggagccguccaagggguggaagaacuggcaggaggugcccuucugcagccaccacuuccacaagaucuucaugaaggacggccgcucccuggucgugcccugccggaaccaggacgagcugaucggccgcgcccgcaucagccagggggcgggcuggucccuccgggagaccgccugccuggggaaggccuacgcccagauguggagccugauguacuuccaccgccgggaccuccgccuggccagcauggcgaucugcuccgccgugcccaccgagugguucccgaccagccggacgaccugguccauccacgcccaccaccaguggaugaccaccgaggacaugcugaaggucuggaaccgcguguggaucgaggacaaccccaacaugaucgacaagacgcccgugcacagcugggaggacauccccuaccucggcaagcgggaggaccuguggugcgggucccugaucggccucagcucccgcgccaccugggccaagaacauccacaccgcgaucacccagguccggaaccugaucggcaaggaggaguacguggacuacaugccggugaugaagcgcuacagcgcccccuccgagagcgaggggguccuguga

SEQ ID NO: 10451 - RNA, 9867 nt, Artificial Sequence
  derived and/or modified CDS sequence (opt1) from DENV-4__FJ882598__SS-prME
agcaccaucacccugcucugccugauccccacggccauggccuuccaccuguccacccgcgacggcgagccgcucaugaucguggcgaagcacgagcgggggcgcccccugcuguucaagaccaccgagggcaucaacaagugcacgcucaucgccauggaccugggggagaugugcgaggacaccgucaccuacaagugcccccugcucgugaacaccgagcccgaggacaucgacugcuggugcaaccugacgagcaccugggugauguacggcaccugcacccaguccggggagcggcgccgggagaagcgcagcgucgcccugacgccgcacuccggcaugggccucgagacccgggccgagaccuggaugagcuccgagggggccuggaagcacgcgcagcgcguggagagcuggauccugcggaaccccggcuucgcccugcucgccggguucauggccuacaugaucggccagaccgggauccagcgcacgguguucuucguccugaugaugcugguggcgcccuccuacggcaugcggugcgugggcgucgggaaccgcgacuucguggagggcgugagcgggggcgccugggucgaccucgugcuggagcacggcgggugcgugaccaccauggcccagggcaagcccacccuggacuucgagcucacgaagaccaccgccaaggaggucgcccugcugcggaccuacugcaucgaggcguccaucagcaacaucacgaccgccacccgcugcccgacccagggggagcccuaccucaaggaggagcaggaccagcaguacaucugccggcgcgacgugguggaccggggcugggggaacggcugcggccuguucgggaagggcggggucgugacgugcgccaaguucuccugcagcggcaagaucaccgggaaccuggugcagaucgagaaccucgaguacaccgucguggugaccguccacaacggcgacacgcacgccgugggcaacgacaccuccaaccacggggucaccgccaccaucacgccccgcagccccuccguggaggugaagcugccggacuacggcgagcugacccucgacugcgagccccggagcgggaucgacuucaacgagaugauccugaugaagaugaagaagaagaccuggcugguccacaagcagugguuccucgaccugccccugcccuggaccgcgggcgccgacaccuccgaggugcacuggaacuacaaggagcgcauggugacguucaaggucccgcacgccaagcggcaggacgugaccgugcucgggagccaggagggcgccaugcacagcgcccuggcgggcgccaccgaggucgacuccggggacggcaaccacauguucgccgggcaccugaagugcaaggugcgcauggagaagcuccgcaucaagggcaugagcuacaccaugugcuccggcaaguucagcaucgacaaggagauggccgagacgcagcacgggaccaccguggucaaggugaaguacgagggcgccggggcgcccugcaaggugcccaucgagauccgggacgucaacaaggagaagguggugggccgcgucaucuccagcaccccccuggccgagaacacgaacuccgugaccaacaucgagcuggagccgcccuucggggacagcuacaucgugaucggcgucggcaacuccgcccucacccugcacugguuccggaaggggagcuccaucggcaagauguucgagagcaccuaccgcggggccaagcggauggcgauccugggcgagacggccugggacuucggguccgugggcggccucuucaccagccuggggaaggccgugcaccaggucuucggcuccguguacaccaccauguucgggggcgugagcuggaugauccgcauccugaucggguuccucguccuguggaucggcacgaacucccggaacaccagcauggccaugaccugcaucgccgugggcgggaucacccuguuccugggcuucacggugcaggcggacauggggugcgucguguccuggagcggccgcgagcucaagugcgggagcggcaucuucguggucgacaacgugcacaccuggaccgagcaguacaaguuccagcccgagucccccgcccggcuggccagcgccauccugaacgcccacaaggacggcgugugcgggauccgcuccaccacgcggcucgagaacgucauguggaagcagaucaccaacgagcugaacuacgugcugugggagggcgggcacgaccucaccguggucgcgggcgacgugaagggcgugcugaccaaggggaagcgcgcccugacgccgcccgucagcgaccucaaguacuccuggaagaccuggggcaaggccaagaucuucacccccgaggcccggaacagcaccuuccugaucgacgggcccgacacguccgagugcccgaacgagcgccgggccuggaacagccuggagguggaggacuacggcuucgggauguucaccaccaacaucuggaugaaguuccgcgagggcuccagcgaggugugcgaccaccggcucauguccgcggccaucaaggaccagaaggccguccacgccgacaugggcuacuggaucgagagcuccaagaaccagaccuggcagaucgagaaggcgagccugaucgaggugaagacgugccuguggcccaagacccacacccucugguccaacggggugcuggagagccagaugcugauccccaaguccuacgccggcccguucagccagcacaacuaccgccagggguacgccacccagaccgucggccccuggcaccucgggaagcuggagaucgacuucggcgagugccccggcacgaccgugaccauccaggaggacugcgaccaccgggggcccagccugcgcaccacgaccgccuccggcaagcucgugacccaguggugcugccgcagcugcaccaugccgccccugcgguuccugggggaggacggcugcugguacgggauggagauccgcccccucuccgagaaggaggagaacauggucaagagccagguggccgcgggccagggcacguccgagaccuucagcauggggcugcugugccucacccuguucgucgaggagugccugcggcgccgggugacccgcaagcacaugauccucgccguggucaucacgcugugcgccaucauccugggcgggcucaccuggauggaccugcugcgggcccucaucaugcugggcgacaccauguccggccgcaucgggggccagacccaccuggccaucauggcgguguucaagaugagccccggguacgugcucggcgucuuccugcggaagcugacgucccgcgagaccgcccucauggugaucgggauggccaugaccaccacgcugagcaucccgcacgaccugauggagcucaucgacggcaucucccugggccugauccuccugaagaucgugacccaguucgacaacacccaggucgggacccuggcccucagccugacguucauccgguccaccaugagccuggugauggccuggcgcaccaucauggcggugcucuucgucgugacccugaucccccugugccggacguccugccuccagaagcagagccacuggguggagaucaccgcccugauccugggcgcccaggcccuccccgucuaccugaugacccugaugaagggggcgucccgccggagcuggccccucaacgagggcaucauggccguggggcuggugucccugcucggcagcgcccugcugaagaacgacgucccgcucgccggccccaugguggccgggggccugcugcucgcggccuacgugaugagcggguccagcgccgaccugucccuggagaaggccgccaacguccagugggacgagauggcggacaucaccggcagcucccccaucaucgaggugaagcaggacgaggacgggagcuucuccauccgcgacguggaggagacgaacaugaucacccuccuggucaagcuggcccucaucaccgugagcggccuguacccccuggccaucccggugaccaugacgcucugguacauguggcaggucaagacccagcgguccggcgcccugugggacgugcccagccccgccgcgacccagaaggccgcccuguccgaggggguguaccgcaucaugcagcggggccucuucgggaagacccaggucggcguggggauccacauggagggcguguuccacaccauguggcacgucacgcgcggcagcgugaucugccacgagaccgggcggcuggagcccuccugggccgacgugcgcaacgacaugaucagcuacggcgggggcuggcgccugggcgacaagugggacaaggaggaggacguccaggugcucgccaucgagccggggaagaaccccaagcacgugcagaccaagcccggccuguucaagacccugacgggggagaucggcgcggucacccucgacuucaagcccgggaccuccggcagcccgaucaucaaccggaagggcaaggugaucgggcuguacggcaacgggguggucaccaaguccggcgacuacgugagcgccaucacgcaggccgagcgcaucggggagcccgacuacgagguggacgaggacaucuuccggaagaagcgccugaccaucauggaccuccaccccggcgccggcaagaccaagcggauccugccguccaucguccgcgaggcgcugaagcggcgccugcggacccucauccuggcccccacgcgcgugguggccgccgagauggaggaggcccugcgggggcuccccauccgcuaccagacccccgcggucaagagcgagcacaccggccgggagaucguggaccugaugugccacgccaccuucacgacccgccugcucagcuccacccgggugccgaacuacaaccugaucgucauggacgaggcccacuucaccgaccccagcuccguggccgcccgcggguacaucagcacgcgggucgagaugggcgaggcggccgccaucuucaugaccgccaccccccccggggccaccgacccguucccccaguccaacagccccaucgaggacaucgagcgcgagauccccgagcgguccuggaacacgggcuucgacuggaucaccgacuaccagggcaagaccgugugguucgugccgagcaucaaggcggggaacgacaucgccaacugccugcgcaaguccggcaagaaggucauccagcucagccgcaagaccuucgacacggaguaccccaagaccaagcugaccgacugggacuucguggugaccacggacaucuccgagaugggggccaacuuccgggccggccgcgucaucgacccccggcgcugccugaagcccgugauccucaccgacgggccggagcgggugauccuggcgggccccauccccgucacccccgccagcgccgcccagcgccggggccgcaucgggcggaacccggcccaggaggacgaccaguacguguucuccggcgacccccugaagaacgacgaggaccacgcgcacuggaccgaggccaagaugcuccuggacaacaucuacacgcccgaggggaucauccccacccuguucggcccggagcgcgagaagacccaggccaucgacggcgaguuccggcuccgcggggagcagcggaagaccuucguggagcugaugcgccggggcgaccugcccgucuggcucagcuacaagguggccuccgccgggaucagcuacaaggaccgcgaguggugcuucacgggcgagcggaacaaccagauccuggaggagaacauggagguggagaucuggacccgcgagggggagaagaagaagcugcggccccgcuggcucgacgcgcgggucuacgccgaccccauggcccugaaggacuucaaggaguucgccuccggccgcaagagcaucacccuggacauccucaccgagaucgccucccugccgaccuaccugagcagccgcgcgaagcucgcccuggacaacaucgugaugcugcacacgaccgagcggggcgggcgcgccuaccagcacgcccucaacgagcugcccgagucccuggagacccucaugcugguggcgcugcucggcgccaugaccgccgggaucuuccuguucuucaugcagggcaaggggaucggcaagcugagcaugggccucaucacgaucgccgucgccuccgggcugcuguggguggcggagauccagccccaguggaucgccgccagcaucauccucgaguucuuccugauggugcugcucaucccggagcccgagaagcagcggaccccccaggacaaccagcugaucuacgucauccugaccauccucaccaucaucggccugaucgccgccaacgagauggggcugaucgagaagacgaagaccgacuucggcuucuaccaggugaagaccgagaccacgauccucgacguggaccugcgccccgcguccgccuggacccuguacgccgucgccaccaccauccucacgccgaugcugcggcacaccaucgagaacaccagcgccaaccugucccucgcggccaucgccaaccaggccgccgugcugauggggcugggcaagggcuggccccuccaccgcauggaccugggggugccccugcucgcgaugggcugcuacagccaggucaaccccaccacgcugaccgccucccuggugaugcuccuggugcacuacgccaucaucgggccgggccugcaggccaaggcgacccgggaggcccagaagcgcaccgccgccggcaucaugaagaaccccacggucgacgggaucaccgugaucgaccucgagcccaucagcuacgaccccaaguucgagaagcagcugggccaggugaugcugcucguccugugcgccgggcagcugcuccugaugcggaccaccugggcguucugcgaggugcugacgcucgccaccggcccgauccugacccugugggaggggaaccccggccgcuucuggaacaccacgaucgccguguccaccgccaacaucuuccggggcagcuaccucgccggggcgggccuggccuucucccugaucaagaacgcccagaccccccgccgggggaccggcacgaccggggagacccucggcgagaaguggaagcgccagcugaacagccuggaccggaaggaguucgaggaguacaagcgcuccggcauccucgaggucgaccggaccgaggccaagagcgcccugaaggacggguccaagaucaagcacgcggugagccgcggcuccagcaagauccgguggaucguggagcgcgggauggucaagcccaagggcaaggugguggaccuggggugcggccgcggcggguggagcuacuacauggccacccucaagaacgucacggaggugaagggcuacaccaaggggggcccggggcacgaggagcccauccccauggccaccuacggcuggaaccuggugaagcugcacuccggcgucgacguguucuacaagcccaccgagcagguggacacgcuccugugcgacaucggggagagcuccagcaacccgaccaucgaggagggccggacccugcgcguccucaagaugguggagcccuggcuguccagcaagcccgaguucugcaucaaggugcugaaccccuacaugccgaccgucaucgaggagcuggagaagcuccagcggaagcacgggggcaaccuggugcgcugcccccugucccggaacagcacgcacgagauguacugggucuccggcgccagcgggaacaucguguccagcgugaacaccaccuccaagaugcuccugaaccgcuucaccacgcggcaccgcaagcccaccuacgagaaggacgucgaccugggcgcggggacccggagcguguccaccgagacggagaagcccgacaugaccaucaucggccgccggcuccagcgccugcaggaggagcacaaggagaccuggcacuacgaccaggagaacccguaccggaccugggccuaccacgggagcuacgaggcccccuccacgggcagcgccuccagcauggugaacggcgucgugaagcugcucaccaagcccugggacgugaucccgauggucacccagcuggccaugaccgacacgacccccuucgggcagcagcgcguguucaaggagaagguggacacccggaccccccagcccaagccgggcacgcgcauggucaugaccaccaccgcgaacuggcugugggcccuccuggggaagaagaagaacccccggcugugcacgcgcgaggaguucaucagcaaggugcgguccaacgccgccaucggcgccguguuccaggaggagcagggguggaccagcgcguccgaggccgucaacgacagccgcuucugggagcucguggacaaggagcgggcccugcaccaggagggcaagugcgaguccugcguguacaacaugaugggcaagcgcgagaagaagcugggggaguucggccgcgccaaggggagccgggccaucugguacauguggcucggcgcgcgcuuccuggaguucgaggcccugggguuccucaacgaggaccacugguucggccgggagaacuccuggagcggcgucgagggggagggccugcaccgccugggguacauccucgaggagaucgacaagaaggacggcgaccugauguacgccgacgacaccgccggcugggacacccggaucacggaggacgaccugcagaacgaggagcucaucaccgagcagauggcgccccaccacaagauccuggccaaggccaucuucaagcugaccuaccagaacaagguggugaagguccuccgccccaccccgcggggggccgugauggacaucaucucccgcaaggaccagcggggcagcgggcaggugggcaccuacgggcugaacacguucaccaacauggagguccagcugauccgccagauggaggccgagggcgugaucacccaggacgacaugcagaaccccaagggccucaaggagcggguggagaaguggcugcgcgagugcggggucgaccggcugaagcgcauggcgaucuccggcgacgacugcguggugaagccccucgacgagcgguucgggaccagccugcuguuccucaacgacaugggcaagguccgcaaggacaucccccagugggagccguccaagggguggaagaacuggcaggaggugcccuucugcagccaccacuuccacaagaucuucaugaaggacggccggucccuggugguccccugccgcaaccaggacgagcugaucggccgggcccgcaucagccagggggccggcuggucccuccgcgagacggccugccuggggaaggccuacgcgcagauguggagccugauguacuuccaccggcgcgaccuccggcuggccagcauggccaucugcuccgccgugcccaccgagugguucccgaccagccgcaccacgugguccauccacgcccaccaccaguggaugaccaccgaggacaugcugaagguguggaaccgggucuggaucgaggacaaccccaacaugaucgacaagacccccgugcacagcugggaggacauccccuaccucggcaagcgcgaggaccuguggugcgggucccugaucggccucagcucccgggcgacgugggccaagaacauccacaccgccaucacccaggugcgcaaccugaucggcaaggaggaguacgucgacuacaugccggugaugaagcgguacagcgcccccuccgagagcgagggggugcuguga

SEQ ID NO: 10452 - RNA, 9867 nt, Artificial Sequence
  derived and/or modified CDS sequence (opt1) from DENV-4__FJ882601__SS-prME
agcaccaucacccugcucugccugauccccaccgugauggccuuccaccuguccacccgcgacggcgagccccucaugaucguggccaagcacgagcgggggcgcccccugcuguucaagaccaccgagggcaucaacaagugcacccucaucgccauggaccugggggagaugugcgaggacaccgugaccuacaagugcccccugcucgugaacaccgagcccgaggacaucgacugcuggugcaaccugaccagcaccugggugauguacgggaccugcacccaguccggggagcggcgccgggagaagcgcagcguggcccugaccccgcacuccggcaugggccucgagacccgggccgagaccuggaugagcuccgagggggccuggaagcacgcccagcgcguggagagcuggauccugcggaaccccggcuucgcgcugcucgccggguucauggccuacaugaucggccagaccgggauccagcgcaccguguucuucgugcugaugaugcugguggcccccuccuacggcaugcggugcgugggcguggggaaccgcgacuucguggagggcgugagcgggggcgcguggguggaccucgugcuggagcacggcgggugcgucaccaccauggcccagggcaagcccacccuggacuucgagcucacgaagaccaccgccaaggagguggcccugcugcggaccuacugcaucgaggccuccaucagcaacaucacgaccgcgacccgcugcccgacccagggggagcccuaccucaaggaggagcaggaccagcaguacaucugccggcgcgacguggucgaccggggcugggggaacggcugcggccuguucgggaagggcgggguggugacgugcgccaaguucuccugcagcggcaagaucaccgggaaccugguccagaucgagaaccucgaguacaccgugguggucaccgugcacaacggcgacacgcacgccgucggcaacgacaccuccaaccacggggugaccgccaccaucacgccccgcagccccuccguggaggucaagcugccggacuacggcgagcugacccucgacugcgagccccggagcgggaucgacuucaacgagaugauccugaugaagaugaagaagaagaccuggcuggugcacaagcagugguuccucgaccugccccugcccuggaccgccggcgcggacaccuccgaggugcacuggaacuacaaggagcgcauggucacguucaaggugccgcacgccaagcggcaggacgugaccguccucgggagccaggagggcgccaugcacagcgcccuggccggcgcgaccgagguggacuccggggacggcaaccacauguucgccgggcaccugaagugcaaggugcgcauggagaagcuccgcaucaagggcaugagcuacaccaugugcuccggcaaguucagcaucgacaaggagauggccgagacgcagcacgggaccaccgucgugaaggugaaguacgagggcgccggggcccccugcaagguccccaucgagauccgggacgugaacaaggagaagguggucggccgcgugaucuccagcacgccccuggcggagaacacgaacuccgugaccaacaucgagcuggagccgcccuucggggacagcuacaucgucaucggcgugggcaacuccgcccucacccugcacugguuccggaaggggagcuccaucggcaagauguucgagagcaccuaccgcggggccaagcggauggccauccugggcgagacggcgugggacuucggguccgugggcggccucuucaccagccuggggaaggccguccaccagguguucggcuccguguacaccaccauguucgggggcgucagcuggaugauccgcauccugaucggguuccucgugcuguggaucggcacgaacucccggaacaccagcauggccaugaccugcaucgccgugggcgggaucacccuguuccugggcuucacgguccaggccgacauggggugcgugguguccuggagcggccgcgagcucaagugcgggagcggcaucuucgucguggacaacgugcacaccuggaccgagcaguacaaguuccagcccgagucccccgcgcggcuggccagcgccauccugaacgcccacaaggacggcgucugcgggauccgcuccaccacgcggcucgagaacgugauguggaagcagaucaccaacgagcugaacuacgugcugugggagggcgggcacgaccucaccgucguggccggcgacgugaagggcguccugaccaaggggaagcgcgcgcugacgccgcccgugagcgaccucaaguacuccuggaagaccuggggcaaggccaagaucuucacccccgaggcccggaacagcaccuuccugaucgacgggcccgacacguccgagugcccgaacgagcgccgggccuggaacagccuggagguggaggacuacggcuucgggauguucaccaccaacaucuggaugaaguuccgcgagggcuccagcgaggucugcgaccaccggcucauguccgccgcgaucaaggaccagaaggccgugcacgccgacaugggcuacuggaucgagagcuccaagaaccagaccuggcagaucgagaaggccagccugaucgaggugaagacgugccuguggcccaagacccacacccucugguccaacgggguccuggagagccagaugcugauccccaaguccuacgcgggcccguucagccagcacaacuaccgccagggguacgccacccagaccgugggccccuggcaccucgggaagcuggagaucgacuucggcgagugccccggcacgaccgugaccauccaggaggacugcgaccaccgggggcccagccugcgcaccacgaccgccuccggcaagcucgucacccaguggugcugccgcagcugcaccaugccgccccugcgguuccugggggaggacggcugcugguacgggauggagauccgcccccucuccgagaaggaggagaacauggucaagagccaggucgccgccggccagggcacguccgagaccuucagcauggggcugcugugccucacccuguucguggaggagugccugcggcgccgggugacccgcaagcacaugauccucgcggucgugaucacgcugugcgccaucauccugggcgggcucaccuggauggaccugcugcgggcccucaucaugcugggcgacaccauguccggccgcaucgggggccagacccaccuggccaucauggccguguucaagaugagccccggguacguccucggcguguuccugcggaagcugacgucccgcgagaccgcgcucauggugaucgggauggccaugaccaccacgcugagcaucccgcacgaccugauggagcucaucgacggcaucucccugggccugauccuccugaagaucgucacccaguucgacaacacccagguggggacccuggcccucagccugacguucauccgguccaccaugagccuggugauggccuggcgcaccaucauggccguccucuucguggugacccugaucccccugugccggacguccugccuccagaagcagagccacugggucgagaucaccgcgcugauccugggcgcccaggcccuccccguguaccugaugacccugaugaagggggccucccgccggagcuggccccucaacgagggcaucauggcgguggggcuggucucccugcucggcagcgcccugcugaagaacgacgugccgcucgccggccccaugguggccgggggccugcugcucgccgcguacgucaugagcggguccagcgccgaccugucccuggagaaggccgccaacgugcagugggacgagauggccgacaucaccggcagcucccccaucaucgaggugaagcaggacgaggacgggagcuucuccauccgcgacgucgaggagacgaacaugaucacccuccuggugaagcuggcgcucaucaccgugagcggccuguacccccuggccaucccggucaccaugacgcucugguacauguggcaggucaagacccagcgguccggcgcccugugggacgugcccagccccgccgccacccagaaggcggcccuguccgagggggucuaccgcaucaugcagcggggccucuucgggaagacccaggugggcguggggauccacauggagggcgucuuccacaccauguggcacgugacgcgcggcagcgugaucugccacgagaccgggcggcuggagcccuccugggccgacguccgcaacgacaugaucagcuacggcgggggcuggcgccugggcgacaagugggacaaggaggaggacguccaggugcucgccaucgagccggggaagaaccccaagcacguccagaccaagcccggccuguucaagacccugacgggggagaucggcgccgugacccucgacuucaagcccgggaccuccggcagcccgaucgugaaccggaagggcaaggucaucgggcuguacggcaacgggguggugaccaaguccggcgacuacgucagcgcgaucacgcaggccgagcgcaucggggagcccgacuacgagguggacgaggacaucuuccggaagaagcgccugaccaucauggaccuccaccccggcgccggcaagaccaagcggauccugccguccaucgugcgcgaggcccugaagcggcgccugcggacccucauccuggcgcccacgcgcgucguggccgccgagauggaggaggcccugcgggggcuccccauccgcuaccagacccccgccgucaagagcgagcacaccggccgggagaucgucgaccugaugugccacgcgaccuucacgacccgccugcucagcuccacccgggugccgaacuacaaccugaucgucauggacgaggcccacuucaccgaccccagcuccguggccgcccgcggguacaucagcacgcggguggagaugggcgaggccgcggccaucuucaugaccgccacgccgcccggggccaccgacccguucccccaguccaacagccccaucgaggacaucgagcgcgagauccccgagcgguccuggaacacgggcuucgacuggaucaccgacuaccagggcaagaccgucugguucgugccgagcaucaaggccgggaacgacaucgcgaacugccugcgcaaguccggcaagaaggugauccagcucagccgcaagaccuucgacacggaguaccccaagaccaagcugaccgacugggacuucgucgugaccacggacaucuccgagaugggggccaacuuccgggccggccgcgugaucgacccccggcgcugccugaagcccgucauccucaccgacgggccggagcgggugauccuggccggccccauccccgugacccccgcgagcgccgcccagcgccggggccgcaucgggcggaacccggcccaggaggacgaccaguacgucuucuccggcgacccccugaagaacgacgaggaccacgcccacuggaccgaggcgaagaugcuccuggacaacaucuacacgcccgaggggaucauccccacccuguucggcccggagcgcgagaagacccaggccaucgacggcgaguuccggcuccgcggggagcagcggaagaccuucguggagcugaugcgccggggcgaccugcccguguggcucagcuacaaggucgccuccgccgggaucagcuacaaggaccgcgaguggugcuucacgggcgagcggaacaaccagauccuggaggagaacauggagguggagaucuggacccgcgagggggagaagaagaagcugcggccccgcuggcucgacgcccggguguacgcggaccccauggcccugaaggacuucaaggaguucgccuccggccgcaagagcaucacccuggacauccucaccgagaucgccucccugccgaccuaccugagcagccgcgccaagcucgcgcuggacaacaucgucaugcugcacacgaccgagcggggcgggcgcgccuaccagcacgcccucaacgagcugcccgagucccuggagacccucaugcugguggcccugcucggcgcgaugaccgccgggaucuuccuguucuucaugcagggcaaggggaucggcaagcugagcaugggccucaucacgaucgccguggccuccgggcugcugugggucgccgagauccagccccaguggaucgcggccagcaucauccucgaguucuuccugauggugcugcucaucccggagcccgagaagcagcggacgccccaggacaaccagcugaucuacgugauccuggccauccucaccaucaucggccugaucgccgccaacgagauggggcugaucgagaagaccaagacggacuucggcuucuaccaggagaagaccgagaccaccauccucgacgucgaccugcgccccgcguccgccuggacgcuguacgccguggccaccaccauccucaccccgaugcugcggcacacgaucgagaacaccagcgccaaccugucccucaccgcgaucgccaaccaggccgccgugcugauggggcugggcaagggcuggccccuccaccgcauggaccugggggucccccugcucgccaugggcugcuacagccaggugaaccccaccacgcugaccgcgucccuggugaugcuccugguccacuacgccaucaucgggccgggccugcaggccaaggccacccgggaggcgcucaagcgcaccgccgccggcaucaugaagaaccccacgguggacgggaucaccgugaucgaccuggagcccaucagcuacgaccccaaguucgagaagcagcugggccaggucaugcuccuggugcugugcgccgggcagcuccugcugaugcggaccaccugggccuucugcgaggugcucacgcuggcgaccggcccgauccugacccucugggaggggaaccccggccgcuucuggaacaccacgaucgccgucuccaccgccaacaucuuccggggcagcuaccuggccggggccggccuggcguucucccucaucaagaacgugcagacgccccggcgggggaccggcacgaccggggagacccugggcgagaaguggaagcgccagcugaacagccucgaccggaaggaguucgaggaguacaagcgcuccggcauccuggagguggaccggaccgaggccaagagcgcccugaaggacggguccaagaucaagcacgccgucagccgcggcuccagcaagauccgguggaucguggagcgcgggauggugaagcccaagggcaaggucguggaccucgggugcggccgcggcggguggagcuacuacauggccacccugaagaacgugacggaggucaagggcuacaccaagggcgggccggggcacgaggagcccauccccauggcgaccuacggcuggaaccuggugaagcuccacuccggcguggacgucuucuacaagcccaccgagcaggucgacacgcugcugugcgacaucggggagagcuccagcaacccgaccaucgaggagggccggacccuccgcgugcugaagauggucgagcccuggcuguccagcaagcccgaguucugcaucaaggugcugaaccccuacaugccgaccgucaucgaggagcucgagaagcugcagcggaagcacgggggcaaccuggugcgcugcccccucucccggaacagcacgcacgagauguacuggguguccggcgccagcgggaacaucgucuccagcgugaacaccaccuccaagaugcugcugaaccgcuucaccacgcggcaccgcaagcccaccuacgagaaggacguggaccucggcgccgggacccggagcgucuccaccgagacggagaagcccgacaugaccaucaucggccgccggcugcagcgccugcaggaggagcacaaggagaccuggcacuacgaccaggagaacccguaccggaccugggccuaccacgggagcuacgaggcgcccuccacgggcagcgccuccagcauggugaacggcguggucaagcuccugaccaagcccugggacgugaucccgauggugacccagcuggccaugaccgacacgacccccuucgggcagcagcgcgucuucaaggagaagguggacacccggacgccccagcccaagccgggcacgcgcauggugaugaccaccaccgccaacuggcucugggcccugcuggggaagaagaagaacccccggcucugcacgcgcgaggaguucaucagcaagguccgguccaacgcggccaucggcgccguguuccaggaggagcagggguggaccagcgccuccgaggccgugaacgacagccgcuucugggagcuggucgacaaggagcgggcgcugcaccaggagggcaagugcgaguccugcguguacaacaugaugggcaagcgcgagaagaagcucggggaguucggccgcgccaaggggagccgggccaucugguacauguggcugggcgcccgcuuccuggaguucgaggcccucggguuccugaacgaggaccacugguucggccgggagaacuccuggagcggcguggagggggagggccugcaccgccucggguacauccuggaggagaucgacaagaaggacggcgaccugauguacgcggacgacaccgccggcugggacacccggaucacggaggacgaccuccagaacgaggagcuggucaccgagcagauggcgccccaccacaagauccuggccaaggcgaucuucaagcucaccuaccagaacaagguggugaagguccugcgccccaccccgcgcggggccgugauggacaucaucucccgcaaggaccagcggggcagcggccaggugggcaccuacgggcugaacacguucaccaacauggagguccagcucauccgccagauggaggccgagggcgugaucacccaggacgacaugcagaaccccaagggccugaaggagcggguggagaaguggcugcgcgagugcggggucgaccggcucaagcgcauggccaucuccggcgacgacugcguggugaagccccuggacgagcgguucgggaccagccuccuguuccugaacgacaugggcaagguccgcaaggacaucccccagugggagccguccaagggguggaagaacuggcaggaggugcccuucugcagccaccacuuccacaagaucuucaugaaggacggccggucccuggugguccccugccgcaaccaggacgagcucaucggccgggcccgcaucagccagggggcgggcuggucccugcgcgagacggccugccuggggaaggccuacgcccagauguggagccucauguacuuccaccggcgcgaccugcggcuggccagcauggcgaucugcuccgccgugcccaccgagugguucccgaccagccgcaccacgugguccauccacgcccaccaccaguggaugaccaccgaggacaugcucaagguguggaaccgggucuggaucgaggacaaccccaacaugaucgacaagacccccgugcacagcugggaggacauccccuaccugggcaagcgcgaggaccuguggugcgggucccucaucggccugagcucccgggccacgugggccaagaacauccacaccgcgaucacccaggugcgcaaccugaucggcaaggaggaguacgucgacuacaugccggugaugaagcgguacagcgcccccuccgagagcgagggggugcucuga

SEQ ID NO: 10453 - RNA, 9867 nt, Artificial Sequence
  derived and/or modified CDS sequence (opt1) from DENV-4__FJ226067__SS-prME
agcaccaucacccugcucugccugauccccaccgugauggccuuccaccuguccacccgggacggcgagccgcucaugaucguggccaagcacgagcgggggcgcccccugcuguucaagaccaccgagggcaucaacaagugcacccucaucgccauggaccugggggagaugugcgaggacaccgugaccuacaagugcccccugcucgugaacaccgagcccgaggacaucgacugcuggugcaaccugaccagcaccugggugauguacgggaccugcacccaguccggggagcggcgccgggagaagcgcagcguggcccugaccccgcacuccggcaugggccucgagacccgggccgagaccuggaugagcuccgagggggccuggaagcacgcccagcgcguggagagcuggauccugcggaaccccggcuucgcgcugcucgccggguucauggccuacaugaucggccagaccgggauccagcgcaccguguucuucgugcugaugaugcugguggcccccuccuacggcaugcggugcgucggcguggggaaccgcgacuucguggagggcgucagcgggggcgcguggguggaccucgugcuggagcacggcgggugcgucaccaccauggcccagggcaagcccacccuggacuucgagcucacgaagaccaccgccaaggagguggcccugcugcggaccuacugcaucgaggccuccaucagcaacaucacgaccgcgacccgcugcccgacccagggggagcccuaccucaaggaggagcaggaccagcaguacaucugccggcgcgacguggucgaccggggcugggggaacggcugcggccuguucgggaagggcgggguggugacgugcgccaaguucuccugcagcggcaagaucaccgggaaccugguccagaucgagaaccucgaguacaccgugguggucaccgugcacaacggcgacacgcacgccgucggcaacgacaccuccaaccacggggugaccgccaccaucacgccccgcagccccuccguggaggucaagcugccggacuacggcgagcugacccucgacugcgagccccggagcgggaucgacuucaacgagaugauccugaugaagaugaagaagaagaccuggcuggugcacaagcagugguuccucgaccugccccugcccuggaccgccggcgcggacaccuccgaggugcacuggaacuacaaggagcgcauggucacguucaaggugccgcacgccaagcggcaggacgugaccguccucgggagccaggagggcgccaugcacagcgcccuggccggcgcgaccgagguggacuccggggacggcaaccacauguucgccgggcaccugaagugcaaggugcgcauggagaagcuccgcaucaagggcaugagcuacaccaugugcuccggcaaguucagcaucgacaaggagauggccgagacgcagcacgggaccaccgucgugaaggugaaguacgagggcgccggggcccccugcaagguccccaucgagauccgggacgugaacaaggagaagguggucggccgcgugaucuccagcacgccccuggcggagaacacgaacuccgugaccaacaucgagcuggagccgcccuucggggacagcuacaucgucaucggcgugggcaacuccgcccucacccugcacugguuccggcgcgggagcuccaucggcaagauguucgagagcaccuaccgcggggccaagcgcauggccauccugggcgagacggcgugggacuucggguccgugggcggccucuucaccagccuggggaaggccguccaccagguguucggcuccguguacaccaccauguucgggggcgucagcuggaugauccggauccugaucggguuccucgugcuguggaucggcacgaacucccgcaacaccagcauggccaugaccugcaucaccgugggcgggaucacgcuguuccugggcuucaccguccaggccgacauggggugcgugguguccuggagcggccgggagcucaagugcgggagcggcaucuucgucguggacaacgugcacaccuggaccgagcaguacaaguuccagcccgagucccccgcccgccuggcgagcgccauccugaacgcccacaaggacggcgucugcgggauccgguccacgacccgccucgagaacgugauguggaagcagaucaccaacgagcugaacuacgcccugugggagggcgggcacgaccucaccguggucgccggcgacgugaagggcgugcugacgaaggggaagcgggcgcugaccccgcccgucagcgaccucaaguacuccuggaagaccuggggcaaggccaagaucuucacccccgaggcccgcaacagcacguuccugaucgacgggcccgacaccuccgagugcccgaacgagcggcgcgccuggaacagccuggagguggaggacuacggcuucgggauguucaccaccaacaucuggaugaaguuccgggagggcuccagcgaggugugcgaccaccgccucauguccgccgcgaucaaggaccagaaggccguccacgccgacaugggcuacuggaucgagagcuccaagaaccagacguggcagaucgagaaggccagccugaucgaggugaagaccugccuguggcccaagacccacacccucugguccaacggggugcuggagagccagaugcugauccccaaguccuacgcgggcccguucagccagcacaacuaccggcagggguacgccacccagacggucggccccuggcaccucgggaagcuggagaucgacuucggcgagugccccggcaccaccgugaccauccaggaggacugcgaccaccgcgggcccagccugcgcacgaccaccgccuccggcaagcucgugacccaguggugcugccggagcugcacgaugccgccccugcgcuuccugggggaggacggcugcugguacgggauggagauccggccccucuccgagaaggaggagaacauggucaagagccaggugaccgccggccagggcaccuccgagaccuucagcauggggcugcugugccucacgcuguucgucgaggagugccugcgccggcgcgugacccggaagcacaugauccucguggucgugaucacccugugcgccaucauccugggcgggcucaccuggauggaccugcugcgcgcgcucaucaugcugggcgacacgauguccggccggaucgggggccagauccaccuggccaucauggccguguucaagaugagccccggguacguccucggcguguuccugcgcaagcugaccucccgggagaccgcccucauggugaucgggauggccaugaccacgguccugagcaucccgcacgaccugauggagcucaucgacggcaucucccugggccugauccuccugaagaucgugacccaguucgacaacacccagguggggacccuggcgcucagccugacguucauccgcuccaccaugccccuggucauggccuggcggaccaucauggccguccucuucguggucacccugaucccccugugccgcacgagcugccuccagaagcagucccacuggguggagaucaccgcccugauccugggcgcccaggcgcuccccguguaccugaugacccugaugaagggggccagccggcgcuccuggccgcucaacgagggcaucauggccgucgggcuggugagccugcucggcuccgcccugcugaagaacgacgugccccucgcgggccccauggucgccgggggccugcugcucgccgccuacgugaugagcgggagcuccgccgaccugagccuggagaaggcggccaacgugcagugggacgagauggccgacaucaccggcuccagccccaucaucgaggucaagcaggacgaggacggguccuucagcauccgggacguggaggagacgaacaugaucacccuccuggugaagcuggcccucaucaccgucuccggccuguacccgcuggccauccccgugaccaugacgcucugguacauguggcaggucaagacccagcgcagcggcgcgcugugggacguccccucccccgccgccacccagaaggccgcccugagcgaggggguguaccggaucaugcagcgcggccucuucgggaagacccaggugggcgucgggauccacauggagggcguguuccacaccauguggcacgugacgcggggcuccgucaucugccacgagaccgggcgccuggagccgagcugggcggacgugcgcaacgacaugaucuccuacggcgggggcuggcggcugggcgacaagugggacaaggaggaggacgugcagguccucgccaucgagcccgggaagaaccccaagcacgugcagaccaagcccggccuguucaagacccugacgggggagaucggcgccgugacccucgacuucaagccggggaccagcggcucccccaucaucaaccgcaagggcaaggucaucgggcuguacggcaacgggguggugaccaagagcggcgacuacgucuccgccaucacgcaggccgagcggaucggggagcccgacuacgagguggacgaggacaucuuccgcaagaagcggcugaccaucauggaccuccacccgggcgcgggcaagaccaagcgcauccugcccagcaucgugcgggaggcccugaagcgccggcugcgcacccucauccuggcccccacgcgggucguggccgcggagauggaggaggcccugcgcgggcuccccauccgguaccagaccccggccgugaaguccgagcacaccggccgcgagaucgucgaccugaugugccacgccaccuucacgacccggcugcucagcagcacccgcgugcccaacuacaaccugaucgucauggacgaggcccacuucaccgaccccuccagcguggcggcccggggguacaucuccacgcgcguggagaugggcgaggccgccgccaucuucaugaccgcgacgcccccgggggccaccgaccccuucccccagagcaacucccccaucgaggacaucgagcgggagaucccggagcgcagcuggaacacgggcuucgacuggaucaccgacuaccagggcaagaccgucugguucgugcccuccaucaaggccgggaacgacaucgccaacugccugcgcaagagcggcaagaaggugauccagcucucccggaagaccuucgacacggaguaccccaagaccaagcugaccgacugggacuucgucgugaccacggacaucagcgagaugggggccaacuuccgcgcgggccgggugaucgacccccgccggugccugaagccggucauccucaccgacgggcccgagcgcgugauccuggccggccccauccccgugaccccggccuccgccgcgcagcggcgcggccggaucgggcgcaaccccgcccaggaggacgaccaguacgucuucagcggcgacccccugaagaacgacgaggaccacgcccacuggaccgaggccaagaugcuccuggacaacaucuacacgcccgaggggaucaucccgacccuguucggccccgagcgggagaagacccaggccaucgacggcgaguuccgccuccgcggggagcagcgcaagaccuucguggagcugaugcggcgcggcgaccugcccguguggcucuccuacaaggucgcgagcgccgggaucuccuacaaggaccgggaguggugcuucacgggcgagcgcaacaaccagauccuggaggagaacauggagguggagaucuggacccgggagggggagaagaagaagcugcgcccccgguggcucgacgcccgcguguacgccgacccgauggcccugaaggacuucaaggaguucgcgagcggccgcaaguccaucacccuggacauccucaccgagaucgccagccugcccaccuaccuguccagccgggccaagcucgcccuggacaacaucgucaugcugcacacgaccgagcgcggcgggcgggccuaccagcacgcgcucaacgagcugcccgagagccuggagacccucaugcugguggcccugcucggcgccaugaccgccgggaucuuccuguucuucaugcagggcaaggggaucggcaagcuguccaugggccucaucgcgaucgccguggccagcgggcugcugugggucgccgagauccagccgcaguggaucgccgcguccaucauccucgaguucuuccugauggugcugcucauccccgagcccgagaagcagcgcacgccccaggacaaccagcugaucuacgugauccugaccauccucaccaucaucggccugaucgccgccaacgagauggggcugaucgagaagaccaagacggacuucggcuucuaccaggucaagaccgagaccaccauccucgacguggaccugcggccggccagcgccuggacgcuguacgcgguggccaccaccauccucacccccaugcugcgccacacgaucgagaacaccuccgccaaccugagccucgccgccaucgcgaaccaggccgccguccugauggggcugggcaagggcuggccccuccaccggauggaccugggggugccccugcucgccaugggcugcuacucccaggugaacccgaccacccugacggccagccuggucaugcuccuggugcacuacgcgaucaucgggcccggccugcaggccaaggccacccgcgaggcccagaagcggaccgcggccggcaucaugaagaaccccaccguggacgggaucacggucaucgaccucgagcccaucuccuacgacccgaaguucgagaagcagcugggccaggugaugcugcucgugcugugcgccgggcagcugcuccugaugcgcaccaccugggccuucugcgagguccugacccucgccacgggccccauccugacccugugggaggggaaccccggccgguucuggaacaccaccaucgcggugagcacggccaacaucuuccgcggcuccuaccucgccggggccggccuggccuucagccugaucaagaacgcgcagacgccccggcgcgggaccggcaccacgggggagacccucggcgagaaguggaagcggcagcugaacucccuggaccgcaaggaguucgaggaguacaagcggagcggcauccucgagguggaccgcaccgaggccaaguccgcccugaaggacgggagcaagaucaagcacgccgucucccggggcagcuccaagauccgcuggaucguggagcgcgggauggugaagccgaagggcaaggucguggaccuggggugcggccggggcggguggagcuacuacauggccacccucaagaacgugaccgaggucaagggcuacacgaagggcgggcccgggcacgaggagcccauccccauggcgaccuacggcuggaaccuggugaagcugcacagcggcguggacgucuucuacaagccgaccgagcaggucgacacccuccugugcgacaucggggaguccagcuccaaccccacgaucgaggagggccgcacccugcgggugcucaagauggucgagcccuggcugagcuccaagcccgaguucugcaucaaggugcugaacccguacaugcccaccgucaucgaggagcuggagaagcuccagcgcaagcacgggggcaaccuggugcggugcccccugagccgcaacuccacccacgagauguacugggugagcggcgccuccgggaacaucgucagcuccgugaacacgaccagcaagaugcuccugaaccgguucaccacccgccaccggaagcccacguacgagaaggacguggaccugggcgccgggacccgcuccgucagcaccgagaccgagaagccggacaugacgaucaucggccggcgccuccagcggcugcaggaggagcacaaggagaccuggcacuacgaccaggagaaccccuaccgcaccugggccuaccacggguccuacgaggcgcccagcaccggcuccgccagcuccauggugaacggcguggucaagcugcucacgaagccgugggacgugauccccauggugacccagcuggccaugaccgacaccacgcccuucgggcagcagcgggucuucaaggagaagguggacacccgcacgccccagccgaagcccggcacccggauggugaugacgaccaccgccaacuggcugugggcccuccuggggaagaagaagaacccccgccugugcacccgggaggaguucaucagcaagguccgcagcaacgcggccaucggcgccguguuccaggaggagcagggguggacguccgccagcgaggccgugaacgacucccgguucugggagcucgucgacaaggagcgcgcgcugcaccaggagggcaagugcgagagcugcguguacaacaugaugggcaagcgcgagaagaagcugggggaguucggccgggccaaggggucccgcgccaucugguacauguggcucggcgcccgguuccuggaguucgaggcccugggguuccucaacgaggaccacugguucggccgcgagaacagcugguccggcguggagggggagggccugcaccggcugggguacauccucgaggagaucgacaagaaggacggcgaccugauguacgcggacgacaccgccggcugggacacccgcaucaccgaggacgaccugcagaacgaggagcucaucacggagcagauggcgccccaccacaagauccuggccaaggcgaucuucaagcugaccuaccagaacaaggucgugaaggugcuccggccgacgccccgcggggccgucauggacaucaucagccggaaggaccagcggggcuccggccaggugggcaccuacgggcugaacaccuucacgaacauggaggugcagcugauccggcagauggaggccgagggcgucaucacccaggacgacaugcagaaccccaagggccucaaggagcgcguggagaaguggcugcgggagugcgggguggaccgccugaagcggauggccaucagcggcgacgacugcgucgugaagccccucgacgagcgcuucgggaccucccugcuguuccucaacgacaugggcaaggugcggaaggacaucccgcagugggagcccagcaagggguggaagaacuggcaggagguccccuucugcucccaccacuuccacaagaucuucaugaaggacggccgcagccugguggugcccugccggaaccaggacgagcugaucggccgcgcccgcaucucccagggggcgggcuggagccuccgggagaccgccugccuggggaaggccuacgcccagauguggucccugauguacuuccaccgccgggaccuccgccuggccagcauggcgaucugcagcgccgucccgacggagugguuccccaccucccggaccaccuggagcauccacgcccaccaccaguggaugacgaccgaggacaugcugaagguguggaaccgcguguggaucgaggacaaccccaacaugaccgacaagacccccguccacuccugggaggacaucccguaccucggcaagcgggaggaccuguggugcgggagccugaucggccucuccagccgcgccacgugggccaagaacauccacaccgcgaucacccaggugcggaaccugaucggcaaggaggaguacguggacuacaugcccgucaugaagcgcuacuccgcccugagcgaguccgagggggugcucuga

SEQ ID NO: 10454 - RNA, 9867 nt, Artificial Sequence
  derived and/or modified CDS sequence (opt1) from DENV-4__EU854299__SS-prME
agcaccaucacccugcucugccugauccccacggugauggccuuccaccuguccacccgcgacggcgagccgcucaugaucgucgccaagcacgagcgggggcgcccccugcuguucaagaccaccgagggcaucaacaagugcacgcucaucgcgauggaccugggggagaugugcgaggacaccgugaccuacaagugcccccugcucgugaacaccgagcccgaggacaucgacugcuggugcaaccugacgagcaccugggucauguacggcaccugcacccaguccggggagcggcgccgggagaagcgcagcguggcccugacgccgcacuccggcaugggccucgagacccgggccgagaccuggaugagcuccgagggggccuggaagcacgcccagcgcguggagagcuggauccugcggaaccccggcuucgcgcugcucgccggguucauggccuacaugaucggccagaccgggauccagcgcacggucuucuucgugcugaugaugcugguggcccccuccuacggcaugcggugcgucggcguggggaaccgcgacuucguggagggcgucagcgggggcgcguggguggaccucgugcuggagcacggcgggugcgucaccaccauggcccagggcaagcccacccuggacuucgagcucacgaagaccaccgccaaggagguggcccugcugcggaccuacugcaucgaggcccucaucuccaacaucacgaccgcgacccgcugcccgacccagggggagcccuaccugaaggaggagcaggaccagcaguacaucugccggcgcgacguggucgaccggggcugggggaacggcugcggccuguucgggaagggcgggguggugacgugcgccaaguucagcugcuccggcaagaucaccgggaaccucguccagaucgagaaccuggaguacaccgugguggucaccgugcacaacggcgacacgcacgccgucggcaacgacaccagcaaccacggggugaccgccaccaucacgccccgcucccccagcguggaggucaagcugccggacuacggcgagcucacccuggacugcgagccccgguccgggaucgacuucaacgagaugauccugaugaagaugaagaagaagaccuggcucgugcacaagcagugguuccuggaccugccccuccccuggaccaccggcgccgacacgagcgaggugcacuggaacuacaaggagcgcauggucaccuucaaggugccgcacgcgaagcggcaggacgugaccguccuggggucccaggagggcgccaugcacagcgcccuggccggcgccaccgagguggacagcggggacggcaaccacauguucgcggggcaccucaagugcaaggugcgcauggagaagcugcgcaucaagggcauguccuacacgaugugcagcggcaaguucuccaucgacaaggagauggccgagacccagcacgggaccaccgucgugaaggugaaguacgagggcgccggggcccccugcaagguccccaucgagauccgggacgugaacaaggagaagguggucggccgcgugaucagcgccacgccccuggcggagaacaccaacuccgugaccaacaucgagcucgagccgcccuucggggacagcuacaucgucaucggcgugggcaacuccgcccugacccugcacugguuccggaaggggagcuccaucggcaagauguucgagagcacguaccgcggggccaagcggauggccauccucggcgagaccgcgugggacuucggguccgugggcggccuguucaccagccuggggaaggccguccaccagguguucggcuccguguacaccacgauguucgggggcgucagcuggaugauccgcauccucaucggguuccuggugcuguggaucggcaccaacucccggaacaccagcauggccaugaccugcaucgccgugggcgggaucacgcuguuccucggcuucaccguccaggccgacauggggugcgugguguccuggagcggccgcgagcugaagugcggguccggcaucuucgucguggacaacgugcacaccuggaccgagcaguacaaguuccagcccgagagccccgcgcggcuggccagcgccauccucaacgcccacaaggacggcgucugcgggauccgcuccacgacccggcuggagaacgugauguggaagcagaucaccaacgagcugaacuacgugcucugggagggcgggcacgaccugaccgucguggccggcgacgugaagggcguccugacgaaggggaagcgcgcgcucaccccgcccgccagcgaccugaaguacuccuggaagaccuggggcaaggccaagaucuucacccccgaggcccggaacagcacguuccugaucgacgggcccgacaccuccgagugcccgaacgagcgccgggccuggaacagcuucgagguggaggacuacggcuucgggauguucaccaccaacaucuggaugaaguuccgcgagggcuccagcgaggugugcgaccaccggcucauguccgcggccaucaaggaccagaaggccguccacgccgacaugggcuacuggaucgagagcuccaagaaccagacguggcagaucgagcgcgcgagccugaucgaggugaagaccugccuguggcccaagacccacacccucugguccaacggggugcuggagagccagaugcugauccccaaguccuacgccggcccguucagccagcacaacuaccggcagggguacgccacccagacggucggccccuggcaccucgggaagcuggagaucgacuucggcgagugccccggcaccaccgugaccauccaggagaacugcgaccaccgcgggcccucccugcgcacgaccaccgccagcggcaagcucgugacccaguggugcugccggagcugcacgaugccgccccugcgcuuccugggggaggacggcugcugguacgggauggagauccggccccucuccgagaaggaggagaacauggucaagagccaggugaccgccggccagggcaccuccgagaccuucagcauggggcugcugugccucacgcuguucgucgaggagugccugcgccggcgcgugacccggaagcacaugauccucgcgguggucaucacccugugcgccaucauccugggcgggcucaccuggauggaccugcugcgcgcccucaucaugcugggcgacacgauguccggccggaucgggggccagacccaccuggccaucauggccguguucaagaugagccccggguacgugcucggcgucuuccugcgcaagcugaccucccgggagaccgcgcucauggugaucgggauggccaugacgaccacccugagcaucccgcacgaccugauggagcucaucgacggcaucucccugggccugauccuccugaagaucgugacccaguucgacaacacgcaggucgggacccuggcccucagccugaccuucauccgcuccaccaugagccuggugauggccuggcggacgaucauggccgugcucuucgucgugacccugaucccccugugccgcaccuccugccuccagaagcagagccacuggguggagaucaccgcgcugauccugggcgcccaggcccuccccgucuaccugaugacgcugaugaagggggccucccggcgcagcuggccccucaacgagggcaucauggcgguggggcuggugucccugcucggcagcgcccugcugaagaacgacgucccgcucgccggccccaugguggccgggggccugcugcucgccgcguacgugauguccgggagcagcgccgaccugucccuggagaaggccgccaacguccagugggacgagauggccgacaucaccggcagcucccccaucaucgaggugaagcaggacgaggacgggagcuucuccauccgggacguggaggagaccaacaugaucacccuccuggucaagcuggcgcucaucacggugagcggccuguacccccuggccaucccgaucaccaugacccucugguacauguggcaggugaagacccagcgcuccggcgcccugugggacguccccagccccgccgccacccagaaggcggcccuguccgaggggguguaccggaucaugcagcgcggccucuucgggaagacgcaggugggcgucgggauccacauggagggcguguuccacaccauguggcacgugacccggggcagcgucaucugccacgagaccgggcgccuggagcccuccugggccgacgugcgcaacgacaugaucagcuacggcgggggcuggcggcugggcgacaagugggacaaggaggaggacgugcagguccucgccaucgagccggggaagaaccccaagcacgugcagacgaagcccggccuguucaagacccugaccggggagaucggcgccgugacccucgacuucaagcccgggacguccggcagcccgaucaucaaccgcaagggcaaggucaucgggcuguacggcaacgggguggugaccaaguccggcgacuacgucagcgcgaucacccaggccgagcggaucggggagcccgacuacgagguggacgaggacaucuuccgcaagaagcggcugaccaucauggaccuccaccccggcgccggcaagacgaagcgcauccugccguccaucgugcgggaggcccugaagcgccggcugcgcacccucauccuggcgcccacccgggucguggccgccgagauggaggaggcccugcgcgggcuccccauccgguaccagacccccgccgugaagagcgagcacacgggccgcgagaucgucgaccugaugugccacgcgaccuucaccacccggcugcucuccagcacgcgcgugccgaacuacaaccugaucgugauggacgaggcccacuucaccgaccccagcuccgucgccgcccggggguacaucagcacccgcguggagaugggcgaggccgcggccaucuucaugaccgccacgccccccggggccaccgacccguucccccaguccaacagccccaucgaggacaucgagcgggagauccccgagcgcuccuggaacaccggcuucgacuggaucaccgacuaccagggcaagacggucugguucgugccgagcaucaaggccgggaacgacaucgcgaacugccugcgcaaguccggcaagaaggugauccagcucagccggaagaccuucgacaccgaguaccccaagaccaagcugacggacugggacuucgucgugaccaccgacaucuccgagaugggggccaacuuccgcgccggccgggugaucgacccccgccggugccugaagcccgucauccucaccgacgggccggagcgcgugauccuggccggccccauccccgugacgcccgcgagcgccgcccagcggcgcggccggaucgggcgcaacccggcccaggaggacgaccaguacgucuucuccggcgacccccugaagaacgacgaggaccacgcccacuggaccgaggcgaagaugcuccuggacaacaucuacacccccgaggggaucauccccacccuguucggcccggagcgggagaagacgcaggccaucgacggcgaguuccgccuccggggggagcagcgcaagaccuucguggagcugaugcggcgcggcgaccugcccguguggcucagcuacaaggucgccuccgccgggaucagcuacaaggaccgggaguggugcuucaccggcgagcgcaacaaccagauccuggaggagaacauggagguggagaucuggacccgggagggggagaagaagaagcugcgccccaaguggcucgacgcccggguguacgcggaccccauggcccugaaggacuucaaggaguucgccuccggccgcaagagcaucacccuggacauccucacggagaucgccucccugccgaccuaccugagcucccgcgccaagcucgcgcuggacaacaucgucaugcugcacaccaccgagcggggcgggcgcgccuaccagcacgcccucaacgagcugcccgagagccuggagacgcucaugcugguggcccugcucggcgcgaugaccgccgggaucuuccuguucuucaugcagggcaaggggaucggcaagcugagcaugggccucaucaccaucgccguggccuccgggcugcugugggucgccgagauccagccccaguggaucgcggccagcaucauccucgaguucuuccugauggugcugcucaucccggagcccgagaagcagcggaccccccaggacaaccagcugaucuacgugauccugacgauccucaccaucaucggccugaucgccgccaacgagauggggcugaucgagaagaccaagaccgacuucggcuucuaccaggucaagacggagaccaccauccucgacguggaccugcgccccgccuccgcguggacccuguacgccguggccacgaccauccucaccccgaugcugcggcacaccaucgagaacacgagcgccaaccugucccucgccgcgaucgccaaccaggccgccguccugauggggcugggcaagggcuggccccuccaccgcauggaccugggggugccccugcucgccaugggcugcuacagccaggugaaccccaccacccugaccgcgucccuggucaugcuccuggugcacuacgccaucaucgggccgggccugcaggccaaggccacgcgggaggcgcagaagcgcaccgccgccggcaucaugaagaaccccaccguggacgggaucaccgucaucgaccucgagcccaucagcuacgaccccaaguucgagaagcagcugggccaggugaugcugcucgugcugugcgccgggcagcugcuccugaugcggacgaccugggccuucugcgagguccugacccucgcgaccggcccgauccugacgcugugggaggggaaccccggccgcuucuggaacaccaccaucgccguguccaccgccaacaucuuccggggcagcuaccucgccggggccggccuggcguucucccugaucaagaacgcccagacgccccgccgggggaccggcaccaccggggagacccucggcgagaaguggaagcgccagcugaacagccuggaccggaaggaguucgaggaguacaagcgcuccggcauccucgagguggaccggacggaggccaagagcgcccugaaggacggguccaagaucaagcacgccgucagccgcggcuccagcaagauccgguggaucguggagcgcgggauggugaagcccaagggcaaggucguggaccuggggugcggccgcggcgggugguccuacuacauggcgacccucaagaacgugaccgaggucaagggcuacaccaaggggggcccggggcacgaggagcccauccccauggccacguacggcuggaaccuggugaagcugcacagcggcguggacgucuucuacaagcccaccgagcagguggacacccuccugugcgacaucggggagagcuccagcaacccgaccaucgaggagggccggacgcugcgcgugcucaagauggucgagcccuggcuguccagcaagcccgaguucugcaucaaggugcugaaccccuacaugccgaccgugaucgaggagcuggagaagcuccagcggaagcacgggggcaaccugguccgcugcccccugucccggaacagcacccacgagauguacuggguguccggcgccagcgggaacaucgucuccagcgugaacaccacguccaagaugcuccugaaccgcuucaccacccggcaccgcaagcccaccuacgagaaggacguggaccugggcgccgggacgcggagcgucuccaccgagaccgagaagcccgacaugaccaucaucggccgccggcuccagcgccugcaggaggagcacaaggagacguggcacuacgaccaggagaacccguaccggaccugggcguaccacgggagcuacgaggcccccuccaccggcagcgccuccagcauggugaacggcguggucaagcugcucaccaagcccugggacgugaucccgauggugacgcagcuggccaugaccgacaccacccccuucgggcagcagcgcgucuucaaggagaagguggacacgcggaccccccagcccaagccgggcacccgcauggugaugaccacgaccgccaacuggcugugggcgcuccuggggaagaagaagaacccccggcugugcacccgcgaggaguucaucuccaagguccggagcaacgccgccaucggcgccguguuccaggaggagcagggguggaccagcgccuccgaggcggugaacgacagccgcuucugggagcucgucgacaaggagcgggcccugcaccaggagggcaagugcgaguccugcguguacaacaugaugggcaagcgcgagaagaagcugggggaguucggccgcgccaaggggagccgggccaucugguacauguggcucggcgcccgcuuccuggaguucgaggcgcugggguuccucaacgaggaccacugguucggccgggagaacuccuggagcggcguggagggggagggccugcaccgccugggguacauccucgaggagaucgacaagaaggacggcgaccugauguacgccgacgacacggccggcugggacacccggaucaccgaggacgaccugcagaacgaggagcucaucaccgagcagauggccccccaccacaagauccuggcgaaggccaucuucaagcugaccuaccagaacaaggucgugaaggugcuccgccccacgccgcggggggccgucauggacaucaucucccgcaaggaccagcggggcagcgggcaggugggcaccuacgggcugaacaccuucaccaacauggaggugcagcugauccgccagauggaggccgagggcgucaucacgcaggacgacaugcagaaccccaagggccucaaggagcggguggagaaguggcugcgcgagugcgggguggaccggcugaagcgcauggccaucuccggcgacgacugcgucgugaagccccucgacgagcgguucgggaccagccugcuguuccucaacgacaugggcaaggugcgcaaggacaucccccagugggagccguccaagggguggaagaacuggcaggagguccccuucugcagccaccacuuccacaagaucuucaugaaggacggccggucccugguggugcccugccgcaaccaggacgagcugaucggccgggcgcgcaucagccagggggccggcuggucccuccgcgagaccgccugccuggggaaggccuacgcccagauguggagccugauguacuuccaccggcgcgaccuccggcuggcguccauggccaucugcagcgccguccccaccgagugguucccgacgagccgcaccaccugguccauccacgcccaccaccaguggaugaccacggaggacaugcugaagguguggaaccggguguggaucgaggacaaccccaacaugaucgacaagacccccguccacagcugggaggacauccccuaccucggcaagcgcgaggaccuguggugcgggucccugaucggccucagcucccgggccaccugggcgaagaacauccacaccgccaucacgcaggugcgcaaccugaucggcaaggaggaguacguggacuacaugccggucaugaagcgguacagcgcccccuccgagagcgagggggugcuguga

SEQ ID NO: 10455 - RNA, 9867 nt, Artificial Sequence
  derived and/or modified CDS sequence (opt1) from DENV-4__FJ182016__SS-prME
agcaccaucacccugcucugccugauccccacggugauggccuuccaccuguccacccgcgacggcgagccgcucaugaucgucgccaagcacgagcgggggcgcccccugcuguucaagaccaccgagggcaucaacaagugcacgcucaucgcgauggaccugggggagaugugcgaggacaccgugaccuacaagugcccccugcucgugaacaccgagcccgaggacaucgacugcuggugcaaccugacgagcaccugggucauguacggcaccugcacccaguccggggagcggcgccgggagaagcgcagcguggcccugacgccgcacuccggcaugggccucgagacccgggccgagaccuggaugagcuccgagggggccuggaagcacgcccagcgcguggagagcuggauccugcggaaccccggcuucgcgcugcucgccggguucauggccuacaugaucggccagaccgggauccagcgcacggucuucuucgugcugaugaugcugguggcccccuccuacggcaugcggugcgucggcguggggaaccgcgacuucguggagggcgucagcgggggcgcguggguggaccucgugcuggagcacggcgggugcgucaccaccauggcccagggcaagcccacccuggacuucgagcucacgaagaccaccgccaaggagguggcccugcugcggaccuacugcaucgaggcccucaucuccaacaucacgaccgcgacccgcugcccgacccagggggagcccuaccugaaggaggagcaggaccagcaguacaucugccggcgcgacguggucgaccggggcugggggaacggcugcggccuguucgggaagggcgggguggugacgugcgccaaguucagcugcuccggcaagaucaccgggaaccucguccagaucgagaaccuggaguacaccgugguggucaccgugcacaacggcgacacgcacgccgucggcaacgacaccagcaaccacggggugaccgccaccaucacgccccgcucccccagcguggaggucaagcugccggacuacggcgagcucacccuggacugcgagccccgguccgggaucgacuucaacgagaugauccugaugaagaugaagaagaagaccuggcucgugcacaagcagugguuccuggaccugccccuccccuggaccaccggcgccgacacgagcgaggugcacuggaacuacaaggagcgcauggucaccuucaaggugccgcacgcgaagcggcaggacgugaccguccuggggucccaggagggcgccaugcacagcgcccuggccggcgccaccgagguggacagcggggacggcaaccacauguucgcggggcaccucaagugcaaggugcgcauggagaagcugcgcaucaagggcauguccuacacgaugugcagcggcaaguucuccaucgacaaggagauggccgagacccagcacgggaccaccgucgugaaggugaaguacgagggcgccggggcccccugcaagguccccaucgagauccgggacgugaacaaggagaagguggucggccgcgugaucagcgccacgccccuggcggagaacaccaacuccgugaccaacaucgagcucgagccgcccuucggggacagcuacaucgucaucggcgugggcaacuccgcccugacccugcacugguuccggaaggggagcuccaucggcaagauguucgagagcacguaccgcggggccaagcggauggccauccucggcgagaccgcgugggacuucggguccgugggcggccuguucaccagccuggggaaggccguccaccagguguucggcuccguguacaccacgauguucgggggcgucagcuggaugauccgcauccucaucggguuccuggugcuguggaucggcaccaacucccggaacaccagcauggccaugaccugcaucgccgugggcgggaucacgcuguuccucggcuucaccguccaggccgacauggggugcgugguguccuggagcggccgcgagcugaagugcggguccggcaucuucgucguggacaacgugcacaccuggaccgagcaguacaaguuccagcccgagagccccgcgcggcuggccagcgccauccucaacgcccacaaggacggcgucugcgggauccgcuccacgacccggcuggagaacgugauguggaagcagaucaccaacgagcugaacuacgugcucugggagggcgggcacgaccugaccgucguggccggcgacgugaagggcguccugacgaaggggaagcgcgcgcucaccccgcccgccagcgaccugaaguacuccuggaagaccuggggcaaggccaagaucuucacccccgaggcccggaacagcacguuccugaucgacgggcccgacaccuccgagugcccgaacgagcgccgggccuggaacagcuucgagguggaggacuacggcuucgggauguucaccaccaacaucuggaugaaguuccgcgagggcuccagcgaggugugcgaccaccggcucauguccgcggccaucaaggaccagaaggccguccacgccgacaugggcuacuggaucgagagcuccaagaaccagacguggcagaucgagcgcgcgagccugaucgaggugaagaccugccuguggcccaagacccacacccucugguccaacggggugcuggagagccagaugcugauccccaaguccuacgccggcccguucagccagcacaacuaccggcagggguacgccacccagacggucggccccuggcaccucgggaagcuggagaucgacuucggcgagugccccggcaccaccgugaccauccaggagaacugcgaccaccgcgggcccucccugcgcacgaccaccgccagcggcaagcucgugacccaguggugcugccggagcugcacgaugccgccccugcgcuuccugggggaggacggcugcugguacgggauggagauccggccccucuccgagaaggaggagaacauggucaagagccaggugaccgccggccagggcaccuccgagaccuucagcauggggcugcugugccucacgcuguucgucgaggagugccugcgccggcgcgugacccggaagcacaugauccucgcgguggucaucacccugugcgccaucauccugggcgggcucaccuggauggaccugcugcgcgcccucaucaugcugggcgacacgauguccggccggaucgggggccagacccaccuggccaucauggccguguucaagaugagccccggguacgugcucggcgucuuccugcgcaagcugaccucccgggagaccgcgcucauggugaucgggauggccaugacgaccacccugagcaucccgcacgaccugauggagcucaucgacggcaucucccugggccugauccuccugaagaucgugacccaguucgacaacacgcaggucgggacccuggcccucagccugaccuucauccgcuccaccaugagccuggugauggccuggcggacgaucauggccgugcucuucgucgugacccugaucccccugugccgcaccuccugccuccagaagcagagccacuggguggagaucaccgcgcugauccugggcgcccaggcccuccccgucuaccugaugacgcugaugaagggggccucccggcgcagcuggccccucaacgagggcaucauggcgguggggcuggugucccugcucggcagcgcccugcugaagaacgacgucccgcucgccggccccaugguggccgggggccugcugcucgccgcguacgugauguccgggagcagcgccgaccugucccuggagaaggccgccaacguccagugggacgagauggccgacaucaccggcagcucccccaucaucgaggugaagcaggacgaggacgggagcuucuccauccgggacguggaggagaccaacaugaucacccuccuggucaagcuggcgcucaucacggugagcggccuguacccccuggccaucccgaucaccaugacccucugguacauguggcaggugaagacccagcgcuccggcgcccugugggacguccccagccccgccgccacccagaaggcggcccuguccgaggggguguaccggaucaugcagcgcggccucuucgggaagacgcaggugggcgucgggauccacauggagggcguguuccacaccauguggcacgugacccggggcagcgucaucugccacgagaccgggcgccuggagcccuccugggccgacgugcgcaacgacaugaucagcuacggcgggggcuggcggcugggcgacaagugggacaaggaggaggacgugcagguccucgccaucgagccggggaagaaccccaagcacgugcagacgaagcccggccuguucaagacccugaccggggagaucggcgccgugacccucgacuucaagcccgggacguccggcagcccgaucaucaaccgcaagggcaaggucaucgggcuguacggcaacgggguggugaccaaguccggcgacuacgucagcgcgaucacccaggccgagcggaucggggagcccgacuacgagguggacgaggacaucuuccgcaagaagcggcugaccaucauggaccuccaccccggcgccggcaagacgaagcgcauccugccguccaucgugcgggaggcccugaagcgccggcugcgcacccucauccuggcgcccacccgggucguggccgccgagauggaggaggcccugcgcgggcuccccauccgguaccagacccccgccgugaagagcgagcacacgggccgcgagaucgucgaccugaugugccacgcgaccuucaccacccggcugcucuccagcacgcgcgugccgaacuacaaccugaucgugauggacgaggcccacuucaccgaccccagcuccgucgccgcccggggguacaucagcacccgcguggagaugggcgaggccgcggccaucuucaugaccgccacgccccccggggccaccgacccguucccccaguccaacagccccaucgaggacaucgagcgggagauccccgagcgcuccuggaacaccggcuucgacuggaucaccgacuaccagggcaagacggucugguucgugccgagcaucaaggccgggaacgacaucgcgaacugccugcgcaaguccggcaagaaggugauccagcucagccggaagaccuucgacaccgaguaccccaagaccaagcugacggacugggacuucgucgugaccaccgacaucuccgagaugggggccaacuuccgcgccggccgggugaucgacccccgccggugccugaagcccgucauccucaccgacgggccggagcgcgugauccuggccggccccauccccgugacgcccgcgagcgccgcccagcggcgcggccggaucgggcgcaacccggcccaggaggacgaccaguacgucuucuccggcgacccccugaagaacgacgaggaccacgcccacuggaccgaggcgaagaugcuccuggacaacaucuacacccccgaggggaucauccccacccuguucggcccggagcgggagaagacgcaggccaucgacggcgaguuccgccuccggggggagcagcgcaagaccuucguggagcugaugcggcgcggcgaccugcccguguggcucagcuacaaggucgccuccgccgggaucagcuacaaggaccgggaguggugcuucaccggcgagcgcaacaaccagauccuggaggagaacauggagguggagaucuggacccgggagggggagaagaagaagcugcgccccaaguggcucgacgcccggguguacgcggaccccauggcccugaaggacuucaaggaguucgccuccggccgcaagagcaucacccuggacauccucacggagaucgccucccugccgaccuaccugagcucccgcgccaagcucgcgcuggacaacaucgucaugcugcacaccaccgagcggggcgggcgcgccuaccagcacgcccucaacgagcugcccgagagccuggagacgcucaugcugguggcccugcucggcgcgaugaccgccgggaucuuccuguucuucaugcagggcaaggggaucggcaagcugagcaugggccucaucaccaucgccguggccuccgggcugcugugggucgccgagauccagccccaguggaucgcggccagcaucauccucgaguucuuccugauggugcugcucaucccggagcccgagaagcagcggaccccccaggacaaccagcugaucuacgugauccugacgauccucaccaucaucggccugaucgccgccaacgagauggggcugaucgagaagaccaagaccgacuucggcuucuaccaggucaagacggagaccaccauccucgacguggaccugcgccccgccuccgcguggacccuguacgccguggccacgaccauccucaccccgaugcugcggcacaccaucgagaacacgagcgccaaccugucccucgccgcgaucgccaaccaggccgccguccugauggggcugggcaagggcuggccccuccaccgcauggaccugggggugccccugcucgccaugggcugcuacagccaggugaaccccaccacccugaccgcgucccuggucaugcuccuggugcacuacgccaucaucgggccgggccugcaggccaaggccacgcgggaggcgcagaagcgcaccgccgccggcaucaugaagaaccccaccguggacgggaucaccgucaucgaccucgagcccaucagcuacgaccccaaguucgagaagcagcugggccaggugaugcugcucgugcugugcgccgggcagcugcuccugaugcggacgaccugggccuucugcgagguccugacccucgcgaccggcccgauccugacgcugugggaggggaaccccggccgcuucuggaacaccaccaucgccguguccaccgccaacaucuuccggggcagcuaccucgccggggccggccuggcguucucccugaucaagaacgcccagacgccccgccgggggaccggcaccaccggggagacccucggcgagaaguggaagcgccagcugaacagccuggaccggaaggaguucgaggaguacaagcgcuccggcauccucgagguggaccggacggaggccaagagcgcccugaaggacggguccaagaucaagcacgccgucagccgcggcuccagcaagauccgguggaucguggagcgcgggauggugaagcccaagggcaaggucguggaccuggggugcggccgcggcgggugguccuacuacauggcgacccucaagaacgugaccgagguccggggcuacaccaaggggggcccggggcacgaggagcccauccccauggccacguacggcuggaaccuggugaagcugcacagcggcguggacgucuucuacaagcccaccgagcagguggacacccuccugugcgacaucggggagagcuccagcaacccgaccaucgaggagggccgcacgcugcgggugcucaagauggucgagcccuggcuguccagcaagcccgaguucugcaucaaggugcugaaccccuacaugccgaccgugaucgaggagcuggagaagcuccagcgcaagcacgggggcaaccugguccggugcccccugucccgcaacagcacccacgagauguacuggguguccggcgccagcgggaacaucgucuccagcgugaacaccacguccaagaugcuccugaaccgguucaccacccgccaccggaagcccaccuacgagaaggacguggaccugggcgccgggacgcgcagcgucuccaccgagaccgagaagcccgacaugaccaucaucggccggcgccuccagcggcugcaggaggagcacaaggagacguggcacuacgaccaggagaacccguaccgcaccugggcguaccacgggagcuacgaggcccccuccaccggcagcgccuccagcauggugaacggcguggucaagcugcucaccaagcccugggacgugaucccgauggugacgcagcuggccaugaccgacaccacccccuucgggcagcagcgggucuucaaggagaagguggacacgcgcaccccccagcccaagccgggcacccggauggugaugaccacgaccgccaacuggcugugggcgcuccuggggaagaagaagaacccccgccugugcacccgggaggaguucaucuccaagguccgcagcaacgccgccaucggcgccguguuccaggaggagcagggguggaccagcgccuccgaggcggugaacgacagccgguucugggagcucgucgacaaggagcgcgcccugcaccaggagggcaagugcgaguccugcguguacaacaugaugggcaagcgcgagaagaagcugggggaguucggccgggccaaggggagccgcgccaucugguacauguggcucggcgcccgguuccuggaguucgaggcgcugggguuccucaacgaggaccacugguucggccgcgagaacuccuggagcggcguggagggggagggccugcaccggcugggguacauccucgaggagaucgacaagaaggacggcgaccugauguacgccgacgacacggccggcugggacacccgcaucaccgaggacgaccugcagaacgaggagcucaucaccgagcagauggccccccaccacaagauccuggcgaaggccaucuucaagcugaccuaccagaacaaggucgugaaggugcuccggcccacgccgcgcggggccgucauggacaucaucucccggaaggaccagcgcggcagcgggcaggugggcaccuacgggcugaacaccuucaccaacauggaggugcagcugauccggcagauggaggccgagggcgucaucacgcaggacgacaugcagaaccccaagggccucaaggagcgcguggagaaguggcugcgggagugcgggguggaccgccugaagcggauggccaucuccggcgacgacugcgucgugaagccccucgacgagcgcuucgggaccagccugcuguuccucaacgacaugggcaaggugcggaaggacaucccccagugggagccguccaagggguggaagaacuggcaggagguccccuucugcagccaccacuuccaccgcaucuucaugaaggacggccggucccugguggugcccugccgcaaccaggacgagcugaucggccgcgcgcggaucagccagggggccggcuggucccuccgcgagaccgccugccuggggaaggccuacgcccagauguggagccugauguacuuccaccggcgcgaccuccggcuggcguccauggccaucugcagcgccguccccaccgagugguucccgacgagccgcaccaccugguccauccacgcccaccaccaguggaugaccacggaggacaugcugaagguguggaaccggguguggaucgaggacaaccccaacaugaucgacaagacccccguccacagcugggaggacauccccuaccucggcaagcgcgaggaccuguggugcgggucccugaucggccucagcucccgggccaccugggcgaagaacauccacaccgccaucacgcaggugcgcaaccugaucggcaaggaggaguacguggacuacaugccggucaugaagcgguacagcgcccccuccgagagcgagggggugcuguga

SEQ ID NO: 10456 - RNA, 9867 nt, Artificial Sequence
  derived and/or modified CDS sequence (opt1) from DENV-4__EU854300__SS-prME
agcaccaucacccugcucugccugauccccacggugauggccuuccaccuguccacccgcgacggcgagccgcucaugaucgucgccaagcacgagcgggggcgcccccugcuguucaagaccaccgagggcaucaacaagugcacgcucaucgcgauggaccugggggagaugugcgaggacaccgugaccuacaagugcccccugcucgugaacaccgagcccgaggacaucgacugcuggugcaaccugacgagcaccugggucauguacggcaccugcacccaguccggggagcggcgccgggagaagcgcagcguggcccugacgccgcacuccggcaugggccucgagacccgggccgagaccuggaugagcuccgagggggccuggaagcacgcccagcgcguggagagcuggauccugcggaaccccggcuucgcgcugcucgccggguucauggccuacaugaucggccagaccgggauccagcgcacggucuucuucgugcugaugaugcugguggcccccuccuacggcaugcggugcgucggcguggggaaccgcgacuucguggagggcgucagcgggggcgcguggguggaccucgugcuggagcacggcgggugcgucaccaccauggcccagggcaagcccacccuggacuucgagcucacgaagaccaccgccaaggagguggcccugcugcggaccuacugcaucgaggcccucaucuccaacaucacgaccgcgacccgcugcccgacccagggggagcccuaccugaaggaggagcaggaccagcaguacaucugccggcgcgacguggucgaccggggcugggggaacggcugcggccuguucgggaagggcgggguggugacgugcgccaaguucagcugcuccggcaagaucaccgggaaccucguccagaucgagaaccuggaguacaccgugguggucaccgugcacaacggcgacacgcacgccgucggcaacgacaccagcaaccacggggugaccgccaccaucacgccccgcucccccagcguggaggucaagcugccggacuacggcgagcucacccuggacugcgagccccgguccgggaucgacuucaacgagaugauccugaugaagaugaagaagaagaccuggcucgugcacaagcagugguuccuggaccugccccuccccuggaccaccggcgccgacacgagcgaggugcacuggaacuacaaggagcgcauggucaccuucaaggugccgcacgcgaagcggcaggacgugaccguccuggggucccaggagggcgccaugcacagcgcccuggccggcgccaccgagguggacagcggggacggcaaccacauguucgcggggcaccucaagugcaaggugcgcauggagaagcugcgcaucaagggcauguccuacacgaugugcagcggcaaguucuccaucgacaaggagauggccgagacccagcacgggaccaccgucgugaaggugaaguacgagggcgccggggcccccugcaagguccccaucgagauccgggacgugaacaaggagaagguggucggccgcgugaucagcgccacgccccuggcggagaacaccaacuccgugaccaacaucgagcucgagccgcccuucggggacagcuacaucgucaucggcgugggcaacuccgcccugacccugcacugguuccggaaggggagcuccaucggcaagauguucgagagcacguaccgcggggccaagcggauggccauccucggcgagaccgcgugggacuucggguccgugggcggccuguucaccagccuggggaaggccguccaccagguguucggcuccguguacaccacgauguucgggggcgucagcuggaugauccgcauccucaucggguuccuggugcuguggaucggcaccaacucccggaacaccagcauggccaugaccugcaucgccgugggcgggaucacgcuguuccucggcuucaccguccaggccgacauggggugcgugguguccuggaacggccgcgagcugaagugcgggagcggcaucuucgucguggacaacgugcacaccuggaccgagcaguacaaguuccagcccgagucccccgcgcggcuggccagcgccauccucaacgcccacaaggacggcgucugcgggauccgcagcacgacccggcuggagaacgugauguggaagcagaucaccaacgagcugaacuacgugcucugggagggcgggcacgaccugaccgucguggccggcgacgugaagggcguccugacgaaggggaagcgcgcgcucaccccgcccgccuccgaccugaaguacagcuggaagaccuggggcaaggccaagaucuucacccccgagacgcggaacuccaccuuccugaucgacgggcccgacaccagcgagugcccgaacgagcgccgggccuggaacuccuucgagguggaggacuacggcuucgggauguucaccacgaacaucuggaugaaguuccgcgagggcagcuccgaggugugcgaccaccggcucaugagcgccgcgaucaaggaccagaaggccguccacgccgacaugggcuacuggaucgaguccagcaagaaccagaccuggcagaucgagcgcgccucccugaucgaggugaagaccugccuguggcccaagacccacacccucuggagcaacggggugcuggagucccagaugcugauccccaagagcuacgcgggcccguucucccagcacaacuaccggcagggguacgccacgcagaccgucggccccuggcaccucgggaagcuggagaucgacuucggcgagugccccggcaccaccgugacgauccaggagaacugcgaccaccgcgggcccagccugcgcaccaccaccgccuccggcaagcucgugacgcaguggugcugccggagcugcaccaugccgccccugcgcuuccugggggaggacggcugcugguacgggauggagauccggccccucagcgagaaggaggagaacauggucaagucccaggugaccgccggccagggcaccagcgagacguucuccauggggcugcugugccucacccuguucgucgaggagugccugcgccggcgcgugacccggaagcacaugauccucgccguggucaucacccugugcgcgaucauccugggcgggcucacguggauggaccugcugcgcgcccucaucaugcugggcgacaccaugagcggccggaucgggggccagacccaccuggccaucauggccguguucaagaugucccccggguacgugcucggcgucuuccugcgcaagcugaccagccgggagacggcccucauggugaucgggauggcgaugaccaccacccuguccaucccgcacgaccugauggagcucaucgacggcaucagccugggccugauccuccugaagaucgugacgcaguucgacaacacccaggucgggacccuggcccucucccugaccuucauccgcagcacgaugucccuggugauggccuggcggaccaucauggccgugcucuucgucgugacccugaucccccugugccgcaccagcugccuccagaagcagucccacuggguggagaucacggcccugauccugggcgcgcaggcccuccccgucuaccugaugacccugaugaagggggccagccggcgcuccuggccccucaacgagggcaucauggccguggggcuggugagccugcucggcuccgcgcugcugaagaacgacgucccgcucgccggccccaugguggccgggggccugcugcucgccgccuacgugaugagcggguccagcgcggaccugagccuggagaaggccgccaacguccagugggacgagauggccgacaucaccggcuccagccccaucaucgaggugaagcaggacgaggacggguccuucagcauccgggacguggaggagaccaacaugaucacgcuccuggucaagcuggcccucaucaccguguccggccuguacccccuggcgaucccgaucaccaugacccucugguacauguggcaggugaagacccagcgcagcggcgcccugugggacguccccucccccgccgccacgcagaaggccgcgcugagcgaggggguguaccggaucaugcagcgcggccucuucgggaagacccaggugggcgucgggauccacaucgagggcguguuccacaccauguggcacgugacccggggcuccgucaucugccacgagacggggcgccuggagcccagcugggccgacgugcgcaacgacaugaucuccuacggcgggggcuggcggcugggcgacaagugggacaaggaggaggacgugcagguccucgccaucgagccggggaagaaccccaagcacgugcagaccaagcccggccuguucaagacccugaccggggagaucggcgccgugacgcucgacuucaagcccgggaccagcggcuccccgaucaucaaccgcaagggcaaggucaucgggcuguacggcaacgggguggugaccaagagcggcgacuacgucuccgccaucacccaggcggagcggaucggggagcccgacuacgagguggacgaggacaucuuccgcaagaagcggcugacgaucauggaccuccaccccggcgccggcaagaccaagcgcauccugccgagcaucgugcgggaggcccugaagcgccggcugcgcacccucauccuggcccccacccgggucguggcggccgagauggaggaggcccugcgcgggcuccccauccgguaccagacgcccgccgugaaguccgagcacaccggccgcgagaucgucgaccugaugugccacgccaccuucaccacgcggcugcucagcuccacccgcgugccgaacuacaaccugaucgugauggacgaggcgcacuucaccgaccccagcagcgucgccgcccggggguacaucuccacccgcguggagaugggcgaggccgccgcgaucuucaugacggccaccccccccggggccaccgacccguucccccagagcaacucccccaucgaggacaucgagcgggagauccccgagcgcagcuggaacaccggcuucgacuggaucacggacuaccagggcaagaccgucugguucgugccguccaucaaggccgggaacgacaucgccaacugccugcgcaagagcggcaagaaggugauccagcucucccggaagaccuucgacaccgaguaccccaagacgaagcugaccgacugggacuucgucgugaccaccgacaucagcgagaugggggcgaacuuccgcgccggccgggugaucgacccccgccggugccugaagcccgucauccucacggacgggccggagcgcgugauccuggccggccccauccccgugacccccgccuccgcggcccagcggcgcggccggaucgggcgcaaccuggcccaggaggacgaccaguacgucuucagcggcgacccgcucaagaacgacgaggaccacgcccacuggaccgaggccaagaugcugcuggacaacaucuacacccccgaggggaucauccccacgcucuucggccccgagcgggagaagacccaggcgaucgacggcgaguuccgccugcggggggagcagcgcaagaccuucguggagcugaugcggcgcggcgaccucccgguguggcuguccuacaaggucgccagcgccgggaucuccuacaaggaccgggaguggugcuucaccggcgagcgcaacaaccagauccuggaggagaacauggagguggagaucuggacccgggagggggagaagaagaagcuccgccccaaguggcuggacgcccggguguacgccgaccccauggcgcugaaggacuucaaggaguucgccagcggccgcaaguccaucacgcucgacauccugaccgagaucgccagccugcccaccuaccucuccagccgcgccaagcuggcccuggacaacaucgucaugcuccacaccacggagcggggcgggcgcgcguaccagcacgcccugaacgagcugccggagucccucgagacccugaugcugguggcccuccugggcgccaugaccgcggggaucuuccuguucuucaugcagggcaaggggaucggcaagcucagcaugggccugaucaccaucgccguggccagcgggcugcucugggucgccgagauccagccccaguggaucgccgcguccaucauccuggaguucuuccugauggugcuccugauccccgagccggagaagcagcggacgccccaggacaaccagcugaucuacgugauccucaccauccugaccaucaucggccugaucgccgccaacgagauggggcucaucgagaagaccaaggccgacuucggcuucuaccaggucaagacggagaccaccauccuggacguggaccugcgccccgccagcgcguggacccucuacgccguggccacgaccauccugacccccaugcugcggcacaccaucgagaacacguccgccaaccucagccuggccgcgaucgccaaccaggccgccguccugauggggcucggcaagggcuggccgcugcaccgcauggaccugggggugccccuccuggccaugggcugcuacucccaggugaaccccaccacccugaccgcgagccucgucaugcugcuggugcacuacgccaucaucgggcccggccuccaggccaaggccacgcgggaggcgcagaagcgcaccgccgccggcaucaugaagaacccgaccguggacgggaucaccgucaucgaccuggagcccaucuccuacgaccccaaguucgagaagcagcugggccaggugaugcuccuggugcugugcgccgggcagcuccugcugaugcggacgaccugggccuucugcgagguccucacccuggcgaccggccccauccugacgcucugggaggggaacccgggccgcuucuggaacaccaccaucgccgugagcaccgccaacaucuuccggggcuccuaccuggccggggccggccuggcguucagccucaucaagaacgcccagacgccccgccgggggaccggcaccaccggggagacccugggcgagaaguggaagcgccagcugaacucccucgaccggaaggaguucgaggaguacaagcgcagcggcauccuggagguggaccggacggaggccaaguccgcccugaaggacgggagcaagaucaagcacgccgucucccgcggcagcuccaagauccgguggaucguggagcgcgggauggugaagcccaagggcaaggucguggaccucgggugcggccgcggcggguggagcuacuacauggcgacccugaagaacgugaccgaggucaagggcuacaccaaggggggccccgggcacgaggagccgauccccauggccacguacggcuggaaccuggugaagcuccacuccggcguggacgucuucuacaagcccaccgagcagguggacacccugcugugcgacaucggggagagcagcuccaaccccaccaucgaggagggccggacgcuccgcgugcugaagauggucgagccguggcugagcuccaagcccgaguucugcaucaaggugcugaaccccuacaugcccaccgugaucgaggagcucgagaagcugcagcggaagcacgggggcaaccugguccgcugcccgcucagccggaacuccacccacgagauguacugggugagcggcgccuccgggaacaucgucagcuccgugaacaccacgagcaagaugcugcugaaccgcuucaccacccggcaccgcaagcccaccuacgagaaggacguggaccucggcgccgggacgcgguccgucagcaccgagaccgagaagcccgacaugaccaucaucggccgccggcugcagcgccugcaggaggagcacaaggagacguggcacuacgaccaggagaaccccuaccggaccugggcguaccacggguccuacgaggccccgagcaccggcuccgccagcuccauggugaacggcguggucaagcuccugaccaagcccugggacgugauccccauggugacgcagcuggccaugaccgacaccaccccguucgggcagcagcgcgucuucaaggagaagguggacacgcggaccccccagcccaagcccggcacccgcauggugaugaccacgaccgccaacuggcucugggcgcugcuggggaagaagaagaacccgcggcucugcacccgcgaggaguucaucagcaagguccgguccaacgccgccaucggcgccguguuccaggaggagcagggguggaccagcgccagcgaggcggugaacgacucccgcuucugggagcuggucgacaaggagcgggcccugcaccaggagggcaagugcgagagcugcguguacaacaugaugggcaagcgcgagaagaagcucggggaguucggccgcgccaaggggucccgggccaucugguacauguggcugggcgcccgcuuccuggaguucgaggcgcucggguuccugaacgaggaccacugguucggccgggagaacagcugguccggcguggagggggagggccugcaccgccucggguacauccuggaggagaucgacaagaaggacggcgaccugauguacgccgacgacacggccggcugggacacccggaucaccgaggacgaccuccagaacgaggagcugaucaccgagcagauggccccccaccacaagauccuggcgaaggccaucuucaagcucaccuaccagaacaaggucgugaaggugcugcgccccacgccccggggggccgucauggacaucaucagccgcaaggaccagcggggcuccgggcaggugggcaccuacgggcugaacaccuucaccaacauggaggugcagcucauccgccagauggaggccgagggcgucaucacgcaggacgacaugcagaacccgaagggccugaaggagcggguggagaaguggcugcgcgagugcgggguggaccggcucaagcgcauggccaucagcggcgacgacugcgucgugaagccccuggacgagcgguucgggaccucccugcucuuccugaacgacaugggcaaggugcgcaaggacaucccccagugggagcccagcaagggguggaagaacuggcaggaggucccguucugcucccaccacuuccacaagaucuucaugaaggacggccggagccugguggugcccugccgcaaccaggacgagcucaucggccgggcgcgcaucucccagggggccggcuggagccugcgcgagaccgccugccuggggaaggccuacgcccagauguggucccucauguacuuccaccggcgcgaccugcggcuggcgagcauggccaucugcuccgccguccccaccgagugguuccccacgagccgcaccaccuggagcauccacgcccaccaccaguggaugaccacggaggacaugcucaagguguggaaccggguguggaucgaggacaacccgaacaugaucgacaagacccccguccacuccugggaggacauccccuaccugggcaagcgcgaggaccuguggugcgggagccucaucggccuguccagccgggccaccugggcgaagaacauccacaccgccaucacgcaggugcgcaaccugaucggcaaggaggaguacguggacuacaugcccgucaugaagcgguacuccgccccgagcgaguccgagggggugcucuga

SEQ ID NO: 10457 - RNA, 9867 nt, Artificial Sequence
  derived and/or modified CDS sequence (opt1) from DENV-4__FJ182017__SS-prME
agcaccaucacccugcucugccugauccccacggugauggccuuccaccuguccacccgcgacggcgagccgcucaugaucgucgccaagcacgagcgggggcgcccccugcuguucaagaccaccgagggcaucaacaagugcacgcucaucgcgauggaccugggggagaugugcgaggacaccgugaccuacaagugcccccugcucgugaacaccgagcccgaggacaucgacugcuggugcaaccugacgagcgccugggucauguacggcaccugcacccaguccggggagcggcgccgggagaagcgcagcguggcccugaccccgcacuccggcaugggccucgagacgcgggccgagaccuggaugagcuccgagggggccuggaagcacgcgcagcgcguggagagcuggauccugcggaaccccggcuucgcccugcucgccggguucauggccuacaugaucggccagaccgggauccagcgcaccgucuucuucgugcugaugaugcugguggcgcccuccuacggcaugcggugcgucggcguggggaaccgcgacuucguggagggcgucagcgggggcgccuggguggaccucgugcuggagcacggcgggugcgucacgaccauggcccagggcaagcccacccuggacuucgagcucaccaagacgaccgccaaggagguggcccugcugcggaccuacugcaucgaggcgcucaucuccaacaucaccacggccacccgcugcccgacccagggggagcccuaccugaaggaggagcaggaccagcaguacaucugccggcgcgacguggucgaccggggcugggggaacggcugcggccuguucgggaagggcgggguggugaccugcgccaaguucagcugcuccggcaagaucacggggaaccucguccagaucgagaaccuggaguacaccgugguggucaccgugcacaacggcgacacccacgccgucggcaacgacacgagcaaccacggggugaccgccaccaucaccccccgcucccccagcguggaggucaagcugccggacuacggcgagcucacgcuggacugcgagccccgguccgggaucgacuucaacgagaugauccugaugaagaugaagaagaagaccuggcucgugcacaagcagugguuccuggaccugccccuccccuggaccaccggcgcggacaccagcgaggugcacuggaacuacaaggagcgcauggucacguucaaggugccgcacgccaagcggcaggacgugaccguccuggggucccaggagggcgccaugcacagcgcccuggccggcgcgaccgagguggacagcggggacggcaaccacauguucgccgggcaccucaagugcaaggugcgcauggagaagcugcgcaucaagggcauguccuacaccaugugcagcggcaaguucuccaucgacaaggagauggccgagacgcagcacgggaccaccgucgugaaggugaaguacgagggcgccggggcccccugcaagguccccaucgagauccgggacgugaacaaggagaagguggucggccgcgugaucagcgcgaccccccuggccgagaacacgaacuccgugaccaacaucgagcucgagccgcccuucggggacagcuacaucgucaucggcgugggcaacuccgcccugacccugcacugguuccggaaggggagcuccaucggcaagauguucgagagcaccuaccgcggggccaagcggauggcgauccucggcgagacggccugggacuucggguccgugggcggccuguucaccagccuggggaaggccguccaccagguguucggcuccguguacaccaccauguucgggggcgucagcuggaugauccgcauccucaucggguuccuggugcuguggaucggcacgaacucccggaacaccagcauggccaugaccugcaucgccgugggcgggaucacccuguuccucggcuucacgguccaggcggacauggggugcgugguguccuggagcggccgcgagcugaagugcggguccggcaucuucgucguggacaacgugcacaccuggaccgagcaguacaaguuccagcccgagagccccgcccggcuggccagcgccauccucaacgcccacaaggacggcgucugcgggauccgcuccaccacgcggcuggagaacgugauguggaagcagaucaccaacgagcugaacuacgugcucugggagggcgggcacgaccugaccgucguggcgggcgacgugaagggcguccugaccaaggggaagcgcgcccucacgccgcccgccagcgaccugaaguacuccuggaagaccuggggcaaggccaagaucuucacccccgaggcccggaacagcaccuuccugaucgacgggcccgacacguccgagugcccgaacgagcgccgggcguggaacagcuucgagguggaggacuacggcuucgggauguucaccaccaacaucuggaugaaguuccgcgagggcuccagcgaggugugcgaccaccggcucauguccgccgccaucaaggaccagaaggccguccacgcggacaugggcuacuggaucgagagcuccaagaaccagaccuggcagaucgagcgcgccagccugaucgaggugaagacgugccuguggcccaagacccacacccucugguccaacggggugcuggagagccagaugcugauccccaaguccuacgccggcccguucagccagcacaacuaccggcagggguacgccacccagaccgucggccccuggcaccucgggaagcuggagaucgacuucggcgagugccccggcacgaccgugaccauccaggagaacugcgaccaccgcgggcccucccugcgcaccacgaccgccagcggcaagcucgugacccaguggugcugccggagcugcaccaugccgccccugcgcuuccugggggaggacggcugcugguacgggauggagauccggccccucuccgagaaggaggagaacauggucaagagccaggugacggcgggccagggcaccuccgagaccuucagcauggggcugcugugccucacccuguucgucgaggagugccugcgccggcgcgugacgcggaagcacaugauccucgccguggucaucacccugugcgccaucauccugggcgggcucaccuggauggaccugcugcgcgcccucaucaugcugggcgacaccauguccggccggaucgggggccagacgcaccuggccaucauggcgguguucaagaugagccccggguacgugcucggcgucuuccugcgcaagcugaccucccgggagaccgcccucauggugaucgggauggccaugaccacgacccugagcaucccgcacgaccugauggagcucaucgacggcaucucccugggccugauccuccugaagaucgugacccaguucgacaacacccaggucgggacgcuggcccucagccugaccuucauccgcuccaccaugagccuggugauggccuggcggaccaucauggcggugcucuucgucgugacgcugaucccccugugccgcaccuccugccuccagaagcagagccacuggguggagaucaccgcccugauccugggcgcccaggcccuccccgucuaccugaugacccugaugaagggggcgucccggcgcagcuggccccucaacgagggcaucauggccguggggcuggugucccugcucggcagcgcccugcugaagaacgacgucccgcucgccggccccaugguggccgggggccugcugcucgcggccuacgugauguccgggagcagcgccgaccugucccuggagaaggccgccaacguccagugggacgagauggcggacaucacgggcagcucccccaucaucgaggugaagcaggacgaggacgggagcuucuccauccgggacguggaggagaccaacaugaucacccuccuggucaagcuggcccucaucaccgugagcggccuguacccccuggccaucccgaucacgaugacccucugguacauguggcaggugaagacccagcgcuccggcgcccugugggacguccccagccccgccgcgacccagaaggccgcccuguccgaggggguguaccggaucaugcagcgcggccucuucgggaagacccaggugggcgucgggauccacauggagggcguguuccacacgauguggcacgugacccggggcagcgucaucugccacgagaccgggcgccuggagcccuccugggccgacgugcgcaacgacaugaucagcuacggcgggggcuggcggcugggcgacaagugggacaaggaggaggacgugcagguccucgccaucgagccggggaagaaccccaagcacgugcagaccaagcccggccuguucaagacgcugaccggggagaucggcgcggugacccucgacuucaagcccgggaccuccggcagcccgaucaucaaccgcaagggcaaggucaucgggcuguacggcaacgggguggugacgaaguccggcgacuacgucagcgccaucacccaggccgagcggaucggggagcccgacuacgagguggacgaggacaucuuccgcaagaagcggcugaccaucauggaccuccaccccggcgccggcaagaccaagcgcauccugccguccaucgugcgggaggcgcugaagcgccggcugcgcacgcucauccuggcccccacccgggucguggccgccgagauggaggaggcccugcgcgggcuccccauccgguaccagacccccgcggugaagagcgagcacaccggccgcgagaucgucgaccugaugugccacgccacguucaccacccggcugcucuccagcacccgcgugccgaacuacaaccugaucgugauggacgaggcccacuucacggaccccagcuccgucgccgcccggggguacaucagcacccgcguggagaugggcgaggcggccgccaucuucaugaccgccaccccccccggggccacggacccguucccccaguccaacagccccaucgaggacaucgagcgggagauccccgagcgcuccuggaacaccggcuucgacuggaucaccgacuaccagggcaagaccgucugguucgugccgagcaucaaggcggggaacgacaucgccaacugccugcgcaaguccggcaagaaggugauccagcucagccggaagacguucgacaccgaguaccccaagaccaagcugaccgacugggacuucgucgugacgaccgacaucuccgagaugggggccaacuuccgcgccggccgggugaucgacccccgccggugccugaagcccgucauccucaccgacgggccggagcgcgugauccuggcgggccccauccccgugacccccgccagcgccgcccagcggcgcggccggaucgggcgcaacccggcccaggaggacgaccaguacgucuucuccggcgacccccugaagaacgacgaggaccacgcgcacuggacggaggccaagaugcuccuggacaacaucuacacccccgaggggaucauccccacccuguucggcccggagcgggagaagacccaggccaucgacggcgaguuccgccuccggggggagcagcgcaagacguucguggagcugaugcggcgcggcgaccugcccguguggcucagcuacaaggucgccuccgccgggaucagcuacaaggaccgggaguggugcuucaccggcgagcgcaacaaccagauccuggaggagaacauggagguggagaucuggacccgggagggggagaagaagaagcugcgccccaaguggcucgacgcgcggguguacgccgaccccauggcccugaaggacuucaaggaguucgccuccggccgcaagagcaucacccuggacauccucaccgagaucgccucccugccgacguaccugagcucccgcgcgaagcucgcccuggacaacaucgucaugcugcacaccaccgagcggggcgggcgcgccuaccagcacgcccucaacgagcugcccgagagccuggagacccucaugcugguggcgcugcucggcgccaugacggccgggaucuuccuguucuucaugcagggcaaggggaucggcaagcugagcaugggccucaucaccaucgccguggccuccgggcugcugugggucgcggagauccagccccaguggaucgccgccagcaucauccucgaguucuuccugauggugcugcucaucccggagcccgagaagcagcggaccccccaggacaaccagcugaucuacgugauccugaccauccucacgaucaucggccugaucgccgccaacgagauggggcugaucgagaagaccaagaccgacuucggcuucuaccaggucaagaccgagacgaccauccucgacguggaccugcgccccgcguccgccuggacccuguacgccguggccaccacgauccucaccccgaugcugcggcacaccaucgagaacaccagcgccaaccugucccucgcggccaucgccaaccaggccgccguccugauggggcugggcaagggcuggccccuccaccgcauggaccugggggugccccugcucgcgaugggcugcuacagccaggugaaccccacgacccugaccgccucccuggucaugcuccuggugcacuacgccaucaucgggccgggccugcaggccaaggcgacccgggaggcccagaagcgcacggccgccggcaucaugaagaaccccaccguggacgggaucaccgucaucgaccucgagcccaucagcuacgaccccaaguucgagaagcagcugggccaggugaugcugcucgcccugugcgcggggcagcugcuccugaugcggaccacgugggccuucugcgaggugcugacccucgccaccggcccgauccugacccugugggaggggaaccccggccgcuucuggaacacgaccaucgccgucuccaccgccaacaucuuccggggcagcuaccucgcgggggccggccuggccuucucccugaucaagaacgcccagaccccccgccgggggacgggcaccaccggggagacccucggcgagaaguggaagcgccagcugaacagccuggaccggaaggaguucgaggaguacaagcgcuccggcauccucgagguggaccggaccgaggccaagagcgcgcugaaggacggguccaagaucaagcacgccgugagccgcggcuccagcaagauccgguggaucgucgagcgcgggauggugaagcccaagggcaagguggucgaccuggggugcggccgcggcgggugguccuacuacauggccacgcucaagaacgugaccgaggugaagggcuacaccaaggggggcccggggcacgaggagcccauccccauggccaccuacggcuggaaccuggucaagcugcacagcggcguggacguguucuacaagcccacggagcaggucgacacccuccugugcgacaucggggagagcuccagcaacccgaccaucgaggagggccggacccugcgcgugcucaagaugguggagcccuggcuguccagcaagcccgaguucugcaucaagguccugaaccccuacaugccgacggugaucgaggagcuggagaagcuccagcggaagcacgggggcaaccuggugcgcugcccccugucccggaacagcacccacgagauguacugggucuccggcgcgagcgggaacaucguguccagcgucaacaccaccuccaagaugcuccugaaccgcuucacgacccggcaccgcaagcccaccuacgagaaggacguggaccugggcgccgggacccggagcguguccacggagaccgagaagcccgacaugaccaucaucggccgccggcuccagcgccugcaggaggagcacaaggagaccuggcacuacgaccaggagaacccguaccggacgugggccuaccacgggagcuacgaggcccccuccaccggcagcgccuccagcauggucaacggcguggugaagcugcucaccaagcccugggacgucaucccgauggugacccagcuggcgaugacggacaccacccccuucgggcagcagcgcguguucaaggagaaggucgacacccggacgccccagcccaagccgggcacccgcauggugaugaccaccacggccaacuggcugugggcccuccuggggaagaagaagaacccccggcugugcacccgcgaggaguucaucuccaaggugcggagcaacgccgccaucggcgcggucuuccaggaggagcagggguggaccagcgccuccgaggccgugaacgacagccgcuucugggagcucguggacaaggagcgggcccugcaccaggagggcaagugcgaguccugcgucuacaacaugaugggcaagcgcgagaagaagcugggggaguucggccgcgccaaggggagccgggcgaucugguacauguggcucggcgcccgcuuccuggaguucgaggcccugggguuccucaacgaggaccacugguucggccgggagaacuccuggagcggcguggagggggagggccugcaccgccugggguacauccucgaggagaucgacaagaaggacggcgaccugauguacgccgacgacaccgcgggcugggacacgcggaucaccgaggacgaccugcagaacgaggagcucaucaccgagcagauggccccccaccacaagauccuggccaaggccaucuucaagcugaccuaccagaacaagguggucaaggugcuccgccccaccccgcggggggccgugauggacaucaucucccgcaaggaccagcggggcagcgggcaggucggcacguacgggcugaacaccuucaccaacauggaggugcagcugauccgccagauggaggcggagggcgugaucacccaggacgacaugcagaaccccaagggccucaaggagcgggucgagaaguggcugcgcgagugcgggguggaccggcugaagcgcauggccaucuccggcgacgacugcguggucaagccccucgacgagcgguucgggacgagccugcuguuccucaacgacaugggcaaggugcgcaaggacaucccccagugggagccguccaagggguggaagaacuggcaggaggugcccuucugcagccaccacuuccacaagaucuucaugaaggacggccggucccuggucgugcccugccgcaaccaggacgagcugaucggccgggcccgcaucagccagggggccggcuggucccuccgcgagaccgccugccuggggaaggcguacgcccagauguggagccugauguacuuccaccggcgcgaccuccggcuggccuccauggccaucugcagcgccgugcccaccgagugguucccgaccagccgcacgaccugguccauccacgcgcaccaccaguggaugaccaccgaggacaugcugaaggucuggaaccggguguggaucgaggacaaccccaacaugaucgacaagacgcccgugcacagcugggaggacauccccuaccucggcaagcgcgaggaccuguggugcgggucccugaucggccucagcucccgggccaccugggccaagaacauccacaccgccaucacccagguccgcaaccugaucggcaaggaggaguacguggacuacaugccggugaugaagcgguacagcgcccccuccgagagcgaggggguccuguga

SEQ ID NO: 10458 - RNA, 9867 nt, Artificial Sequence
  derived and/or modified CDS sequence (opt1) from DENV-4__EU854301__SS-prME
agcaccaucacccugcucugccugauccccacggugauggccuuccaccuguccacccgcgacggcgagccgcucaugaucgucgccaagcacgagcgggggcgcccccugcuguucaagaccaccgagggcaucaacaagugcacgcucaucgcgauggaccugggggagaugugcgaggacaccgugaccuacaagugcccccugcucgugaacaccgagcccgaggacaucgacugcuggugcaaccugacgagcaccugggucauguacggcaccugcacccaguccggggagcggcgccgggagaagcgcagcguggcccugacgccgcacuccggcaugggccucgagacccgggccgagaccuggaugagcuccgagggggccuggaagcacgcccagcgcguggagagcuggauccugcggaaccccggcuucgcgcugcucgccggguucauggccuacaugaucggccagaccgggauccagcgcacggucuucuucgugcugaugaugcugguggcccccuccuacggcaugcggugcgucggcguggggaaccgcgacuucguggagggcgucagcgggggcgcguggguggaccucgugcuggagcacggcgggugcgucaccaccauggcccagggcaagcccacccuggacuucgagcucacgaagaccaccgccaaggagguggcccugcugcggaccuacugcaucgaggccuccaucagcaacaucacgaccgcgacccgcugcccgacccagggggagcccuaccucaaggaggagcaggaccagcaguacaucugccggcgcgacguggucgaccggggcugggggaacggcugcggccuguucgggaagggcgggguggugacgugcgccaaguucuccugcagcggcaagaucaccgggaaccugguccagaucgagaaccucgaguacaccgugguggucaccgugcacaacggcgacacgcacgccgucggcaacgacaccuccaaccacggggugaccgccaccaucacgccccgcagccccuccguggaggucaagcugccggacuacggcgagcugacccucgacugcgagccccggagcgggaucgacuucaacgagaugauccugaugaagaugaagaagaagaccuggcuggugcacaagcagugguuccucgaccugccccugcccuggaccaccggcgccgacacguccgaggugcacuggaacuacaaggagcgcauggucaccuucaaggugccgcacgcgaagcggcaggacgugaccguccucgggagccaggagggcgccaugcacagcgcccuggccggcgccaccgagguggacuccggggacggcaaccacauguucgcggggcaccugaagugcaaggugcgcauggagaagcuccgcaucaagggcaugagcuacacgaugugcuccggcaaguucagcaucgacaaggagauggccgagacccagcacgggaccaccgucgugaaggugaaguacgagggcgccggggcccccugcaagguccccaucgagauccgggacgugaacaaggagaagguggucggccgcgugaucuccgccacgccccuggcggagaacaccaacagcgugaccaacaucgagcuggagccgcccuucggggacuccuacaucgucaucggcgugggcaacagcgcccucacccugcacugguuccggaagggguccagcaucggcaagauguucgaguccacguaccgcggggccaagcggauggccauccugggcgagaccgcgugggacuucgggagcgugggcggccucuucaccucccuggggaaggccguccaccagaucuucggcagcguguacaccacgauguucgggggcguguccuggaugauccgcauccugaucggguuccucguccuguggaucggcaccaacagccggaacaccuccauggccaugaccugcaucgccgugggcgggaucacgcuguuccugggcuucaccgugcaggccgacauggggugcgucgugagcugguccggccgcgagcucaagugcgggagcggcaucuucguggucgacaacgugcacaccuggaccgagcaguacaaguuccagcccgagagccccgcgcggcuggccuccgccauccugaacgcccacaaggacggcgugugcgggauccgcagcacgacccggcucgagaacgucauguggaagcagaucaccaacgagcugaacuacgugcugugggagggcgggcacgaccucaccguggucgccggcgacgugaagggcgugcugacgaaggggaagcgcgcgcugaccccgcccgccuccgaccucaaguacagcuggaagaccuggggcaaggccaagaucuucacccccgaggcccggaacuccacguuccugaucgacgggcccgacaccagcgagugcccgaacgagcgccgggccuggaacuccuucgaggucgaggacuacggcuucgggauguucaccaccaacaucuggaugaaguuccgcgagggcagcuccgaggugugcgaccaccggcugaugagcgcggccaucaaggaccagaaggccgugcacgccgacaugggcuacuggaucgaguccagcaagaaccagacguggcagaucgagcgcgcgucccucaucgaggucaagaccugccuguggcccaagacccacacccuguggagcaacggggugcucgagucccagaugcugauccccaagagcuacgccggcccguucucccagcacaacuaccggcagggguacgccacccagacggugggccccuggcaccuggggaagcucgagaucgacuucggcgagugccccggcaccaccgucaccauccaggagaacugcgaccaccgcgggcccagccugcgcacgaccaccgccagcggcaagcuggugacccaguggugcugccgguccugcacgaugccgccccuccgcuuccugggggaggacggcugcugguacgggauggagauccggccccugagcgagaaggaggagaacauggugaagucccaggucaccgccggccagggcaccagcgagaccuucuccauggggcuccugugccugacgcucuucguggaggagugccugcgccggcgcgucacccggaagcacaugauccuggcgguggugaucacccucugcgccaucauccugggcgggcugaccuggauggaccuccugcgcgcccugaucaugcucggcgacacgaugagcggccggaucgggggccagacccaccuggccaucauggccgucuucaagaugucccccggguacgugcugggcguguuccuccgcaagcugaccagccgggagaccgcgcugauggucaucgggauggccaugacgaccacccucuccaucccgcacgaccugauggagcugaucgacggcaucagccucggccugauccugcucaagaucgugacccaguucgacaacacgcagguggggacccuggcccugucccucaccuucauccgcagcaccaugucccuggucauggccuggcggacgaucauggccgugcuguucguggucacccucaucccccugugccgcaccagcugccugcagaagcagucccacuggguggagaucaccgcgcucauccugggcgcccaggcccugcccguguaccucaugacgcugaugaagggggccagccggcgcuccuggccccugaacgagggcaucauggcggucgggcucgugagccugcugggcuccgcccuccugaagaacgacgugccgcuggccggccccauggucgccgggggccuccugcuggccgcguacgugaugagcgggagcuccgccgaccucagccuggagaaggccgccaacgugcagugggacgagauggccgacaucaccggcuccagccccaucaucgaggucaagcaggacgaggacggguccuucagcauccgggacguggaggagaccaacaugaucacccugcucgugaagcuggcgcugaucacggucuccggccucuacccccuggccaucccgaucaccaugacccugugguacauguggcaggugaagacccagcgcagcggcgcccucugggacgugcccucccccgccgccacccagaaggcggcccugagcgagggggucuaccggaucaugcagcgcggccuguucgggaagacgcaggugggcguggggauccacauggagggcgucuuccacaccauguggcacgugacccggggcuccgugaucugccacgagaccgggcgccucgagcccagcugggccgacguccgcaacgacaugaucuccuacggcgggggcuggcggcugggcgacaagugggacaaggaggaggacgugcaggugcuggccaucgagccggggaagaaccccaagcacguccagacgaagcccggccucuucaagacccugaccggggagaucggcgccgugacccuggacuucaagcccgggacgagcggcuccccgaucaucaaccgcaagggcaaggugaucgggcucuacggcaacggggucgugaccaagagcggcgacuacguguccgcgaucacccaggccgagcggaucggggagcccgacuacgaggucgacgaggacaucuuccgcaagaagcggcugaccaucauggaccugcaccccggcgccggcaagacgaagcgcauccucccgagcaucgugcgggaggcccugaagcgccggcugcgcacccugauccucgcgcccacccggguggucgccgccgagauggaggaggcccugcgcgggcugcccauccgguaccagacccccgccgugaaguccgagcacacgggccgcgagaucguggaccucaugugccacgcgaccuucaccacccggcugcugagcagcacgcgcgucccgaacuacaaccucaucgugauggacgaggcccacuucaccgaccccuccagcguggccgcccggggguacaucuccacccgcgucgagaugggcgaggccgcggccaucuucaugaccgccacgccccccggggccaccgacccguucccccagagcaacucccccaucgaggacaucgagcgggagauccccgagcgcagcuggaacaccggcuucgacuggaucaccgacuaccagggcaagacggugugguucgucccguccaucaaggccgggaacgacaucgcgaacugccugcgcaagagcggcaagaaggugauccagcugucccggaagaccuucgacaccgaguaccccaagaccaagcucacggacugggacuucguggucaccaccgacaucagcgagaugggggccaacuuccgcgccggccgggugaucgacccccgccggugccugaagcccgugauccugaccgacgggccggagcgcgucauccucgccggccccauccccgugacgcccgcguccgccgcccagcggcgcggccggaucgggcgcaacccggcccaggaggacgaccaguacguguucagcggcgacccccugaagaacgacgaggaccacgcccacuggaccgaggcgaagaugcugcucgacaacaucuacacccccgaggggaucauccccacccuguucggcccggagcgggagaagacgcaggccaucgacggcgaguuccgccugcggggggagcagcgcaagaccuucgucgagcucaugcggcgcggcgaccugcccguguggcuguccuacaagguggccagcgccgggaucuccuacaaggaccgggaguggugcuucaccggcgagcgcaacaaccagauccucgaggagaacauggaggucgagaucuggacccgggagggggagaagaagaagcugcgccccaaguggcuggacgcccggguguacgcggaccccauggcccucaaggacuucaaggaguucgccagcggccgcaaguccaucacccuggacauccugacggagaucgccagccucccgaccuaccuguccagccgcgccaagcuggcgcucgacaacaucgugaugcugcacaccaccgagcggggcgggcgcgccuaccagcacgcccugaacgagcuccccgagagccuggagacgcugaugcucgucgcccugcugggcgcgaugaccgccgggaucuuccucuucuucaugcagggcaaggggaugggcaagcuguccaugggccugaucaccaucgccguggccagcgggcuccuguggguggccgagauccagccccaguggaucgcggccuccaucauccuggaguucuuccucaugguccugcugaucccggagcccgagaagcagcggaccccccaggacaaccagcucaucuacgugauccugacgauccugaccaucaucggccucaucgccgccaacgagauggggcugaucgagaagaccaagaccgacuucggcuucuaccaggugaagacggagaccaccauccuggacgucgaccuccgccccgccagcgcguggacccuguacgccguggccacgaccauccugaccccgaugcuccggcacaccaucgagaacacguccgccaaccugagccuggccgcgaucgccaaccaggccgccgugcucauggggcugggcaagggcuggccccugcaccgcauggaccucggggucccccugcuggccaugggcugcuacucccaggugaaccccaccacccucaccgcgagccuggugaugcugcucguccacuacgccaucaucgggccgggccugcaggccaaggccacgcgggaggcgcagaagcgcaccgccgccggcaucaugaagaaccccaccguggacgggaucaccgugaucgaccuggagcccaucuccuacgaccccaaguucgagaagcagcucggccaggucaugcugcuggugcucugcgccgggcagcuguuccugaugcggacgaccugggccuucugcgaggugcucacccuggcgaccggcccgauccugacgcucugggaggggaaccccggccgcuucuggaacaccaccaucgccgucagcaccgccaacaucuuccggggcuccuaccuggccggggccggccuggcguucagccucaucaagaacgcccagacgccccgccgggggaccggcaccaccggggagacccugggcgagaaguggaagcgccagcugaacucccucgaccggaaggaguucgaggaguacaagcgcagcggcauccuggagguggaccggacggaggccaaguccgcccugaaggacgggagcaagaucaagcacgccgugucccgcggcagcuccaagauccgguggaucgucgagcgcgggauggugaagcccaagggcaagguggucgaccucgggugcggccgcggcggguggagcuacuacauggcgacccugaagaacgugaccgaggugaagggcuacaccaaggggggcccggggcacgaggagcccauccccauggccacguacggcuggaaccuggucaagcuccacagcggcguggacguguucuacaagcccaccgagcaggucgacacccugcugugcgacaucggggaguccagcuccaacccgaccaucgaggagggccggacgcuccgcgugcugaagaugguggagcccuggcugagcuccaagcccgaguucugcaucaagguccucaaccccuacaugccgaccgugaucgaggagcuggagaagcugcagcggaagcacgggggcaaccuggugcgcugcccccucagccggaacuccacccacgagauguacugggucagcggcgccuccgggaacaucgugagcuccgucaacaccacgagcaagaugcugcugaaccgcuucaccacccggcaccgcaagcccaccuacgagaaggacguggaccucggcgccgggacgcgguccgugagcaccgagaccgagaagcccgacaugaccaucaucggccgccggcugcagcgccugcaggaggagcacaaggagacguggcacuacgaccaggagaacccguaccggaccugggcguaccacggguccuacgaggcccccagcaccggcuccgccagcuccauggucaacggcguggugaagcuccugaccaagcccugggacgucaucccgauggugacgcagcuggccaugaccgacaccacccccuucgggcagcagcgcguguucaaggagaaggucgacacgcggaccccccagcccaagccgggcacccgcauggugaugaccacgaccgccaacuggcucugggcgcugcuggggaagaagaagaacccccggcucugcacccgcgaggaguucaucagcaaggugcggagcaacgccgccaucggcgccgucuuccaggaggagcagggguggaccuccgccagcgaggcggugaacgacucccgcuucugggagcugguggacaaggagcgggcccugcaccaggagggcaagugcgagagcugcgucuacaacaugaugggcaagcgcgagaagaagcucggggaguucggccgcgccaaggggucccgggccaucugguacauguggcugggcgcccgcuuccuggaguucgaggcgcucggguuccugaacgaggaccacugguucggccgggagaacagcugguccggcguggagggggagggccugcaccgccucggguacauccuggaggagaucgacaagaaggacggcgaccugauguacgccgacgacacggccggcugggacacccggaucaccgaggacgaccuccagaacgaggagcugaucaccgagcagauggccccccaccacaagauccuggcgaaggccaucuucaagcucaccuaccagaacaagguggucaaggugcugcgccccacgccgcggggggccgugauggacaucaucagccgcaaggaccagcggggcuccgggcaggucggcaccuacgggcugaacaccuucaccaacauggaggugcagcucauccgccagauggaggccgagggcgugaucacgcaggacgacaugcagaaccccaagggccugaaggagcgggucgagaaguggcugcgcgagugcgggguggaccggcucaagcgcauggccaucagcggcgacgacugcguggucaagccccuggacgagcgguucgggaccucccugcucuuccugaacgacaugggcaaggugcgcaaggacaucccccagugggagccgagcaagggguggaagaacuggcaggaggugcccuucugcucccaccacuuccacaagaucuucaugaaggacggccggagccuggucgugcccugccgcaaccaggacgagcucaucggccgggcgcgcaucucccagggggccggcuggagccugcgcgagaccgccugccuggggaaggccuacgcccagauguggucccucauguacuuccaccggcgcgaccugcggcuggcgagcauggccaucugcagcgccgugcccaccgagugguucccgacgucccgcaccaccuggagcauccacgcccaccaccaguggaugaccacggaggacaugcucaaggucuggaaccggguguggaucgaggacaaccccaacaugaucgacaagacccccgugcacuccugggaggacauccccuaccugggcaagcgcgaggaccuguggugcgggagccucaucggccuguccagccgggccaccugggcgaagaacauccacaccgccaucacgcagguccgcaaccugaucggcaaggaggaguacguggacuacaugccggccaugaagcgguacuccgcccccagcgaguccgagggggugcucuga

SEQ ID NO: 10459 - RNA, 9867 nt, Artificial Sequence
  derived and/or modified CDS sequence (opt1) from DENV-4__FJ639736__SS-prME
agcaccaugacccugcucugccugauccccacggccauggccuuccaccuguccacccgcgacggcgagccgcucaugaucguggcgaagcacgagcgggggcgcccccugcuguucaagaccaccgagggcaucaacaagugcacgcucaucgccauggaccugggggagaugugcgaggacaccgucaccuacaagugcccccugcucgugaacaccgagcccgaggacaucgacugcuggugcaaccugacgagcaccugggugauguacggcaccugcacccaguccggggagcggcgccgggagaagcgcagcgucgcccugacgccgcacuccggcaugggccucgagacccgggccgagaccuggaugagcuccgagggggccuggaagcacgcgcagcgcguggagagcuggauccugcggaaccccggcuucgcccugcucgccggguucauggccuacaugaucggccagaccgggauccagcgcacgguguucuucguccugaugaugcugguggcgcccuccuacggcaugcggugcgugggcgucgggaaccgcgacuucguggagggcgugagcgggggcgccugggucgaccucgugcuggagcacggcgggugcgugaccaccauggcccagggcaagcccacccuggacuucgagcucacgaagaccaccgccaaggaggucgcccugcugcggaccuacugcaucgaggcgcucaucuccaacaucacgaccgccacccgcugcccgacccagggggagcccuaccugaaggaggagcaggaccagcaguacaucugccggcgcgacgugguggaccggggcugggggaacggcugcggccuguucgggaagggcggggucgugacgugcgccaaguucagcugcuccggcaagaucaccgggaaccucgugcagaucgagaaccuggaguacaccgucguggugaccguccacaacggcgacacgcacgccgugggcaacgacaccagcaaccacggggucaccgccaccaucacgccccgcucccccagcguggaggugaagcugccggacuacggcgagcucacccuggacugcgagccccgguccgggaucgacuucaacgagaugauccugaugaagaugaagaagaagaccuggcucguccacaagcagugguuccuggaccugccccuccccuggaccgcgggcgccgacaccagcgaggugcacuggaacuacaaggagcgcauggugacguucaaggucccgcacgccaagcggcaggacgugaccgugcuggggucccaggagggcgccaugcacagcgcccuggcgggcgccaccgaggucgacagcggggacggcaaccacauguucgccgggcaccucaagugcaaggugcgcauggagaagcugcgcaucaagggcauguccuacaccaugugcagcggcaaguucuccaucgacaaggagauggccgagacgcagcacgggaccaccguggucaaggugaaguacgagggcgccggggcgcccugcaaggugcccaucgagauccgggacgucaacaaggagaagguggugggccgcgucaucagcuccaccccccuggccgagaacacgaacagcgugaccaacaucgagcucgagccgcccuucggggacuccuacaucgugaucggcgucggcaacagcgcccugacccugcacugguuccggaagggguccagcaucggcaagauguucgaguccaccuaccgcggggccaagcggauggcgauccucggcgagacggccugggacuucgggagcgugggcggccuguucaccucccuggggaaggccgugcaccaggucuucggcagcguguacaccaccauguucgggggcguguccuggaugauccgcauccucaucggguuccugguccuguggaucggcacgaacagccggaacaccuccauggccaugaccugcaucgccgugggcgggaucacccuguuccucggcuucacggugcaggcggacauggggugcgucgugagcugguccggccgcgagcugaagugcgggagcggcaucuucguggucgacaacgugcacaccuggaccgagcaguacaaguuccagcccgagagccccgcccggcuggccuccgccauccucaacgcccacaaggacggcgugugcgggauccgcagcaccacgcggcuggagaacgucauguggaagcagaucaccaacgagcugaacuacgugcucugggagggcgggcacgaccugaccguggucgcgggcgacgugaagggcgugcugaccaaggggaagcgcgcccucacgccgcccgucuccgaccugaaguacagcuggaagaccuggggcaaggccaagaucuucacccccgaggcccggaacuccaccuuccugaucgacgggcccgacacgagcgagugcccgaacgagcgccgggccuggaacucccucgagguggaggacuacggcuucgggauguucaccaccaacaucuggaugaaguuccgcgagggcagcuccgaggugugcgaccaccggcugaugagcgcggccaucaaggaccagaaggccguccacgccgacaugggcuacuggaucgaguccagcaagaaccagaccuggcagaucgagcgcgcgucccugaucgaggugaagacgugccucuggcccaagacccacacccuguggagcaacggggugcuggagucccagaugcucauccccaagagcuacgccggcccguucucccagcacaacuaccggcagggguacgccacccagaccgucggccccuggcaccuggggaagcuggagaucgacuucggcgagugccccggcacgaccgugaccauccaggaggacugcgaccaccgcgggcccagccuccgcaccacgaccgccagcggcaagcuggugacccaguggugcugccgguccugcaccaugccgccccugcgcuuccucggggaggacggcugcugguacgggauggagauccggccccugagcgagaaggaggagaacauggucaagucccaggugacggccggccagggcaccagcgagaccuucuccauggggcugcucugccugacccuguucgucgaggagugccuccgccggcgcgugacgcggaagcacaugauccuggcgguggucaucacccugugcgccaucauccucggcgggcugaccuggauggaccugcuccgcgcccugaucaugcugggcgacaccaugagcggccggaucgggggccagacgcaccucgccaucauggccguguucaagaugucccccggguacgugcugggcgucuuccugcgcaagcucaccagccgggagaccgcgcugauggugaucgggauggccaugaccacgacccuguccaucccgcacgaccucauggagcugaucgacggcaucagccugggccucauccugcugaagaucgugacccaguucgacaacacccaggucgggacgcucgcccugucccugaccuucauccgcagcaccaugucccucgugauggccuggcggaccaucauggccgugcuguucgucgugacgcugaucccccucugccgcaccagcugccugcagaagcagucccacuggguggagaucaccgcgcugauccucggcgcccaggcccugcccgucuaccugaugacccucaugaagggggccagccggcgcuccuggccccugaacgagggcaucauggcgguggggcuggugagccuccugggcuccgcccugcucaagaacgacgucccgcuggccggccccaugguggccgggggccugcuccuggccgcguacgugaugagcgggagcuccgccgaccugagccucgagaaggccgccaacguccagugggacgagauggccgacaucacgggcuccagccccaucaucgaggugaagcaggacgaggacggguccuucagcauccgggacguggaggagaccaacaugaucacccugcuggucaagcucgcgcugaucaccguguccggccuguacccccucgccaucccggugacgaugacccugugguacauguggcaggucaagacccagcgcagcggcgcccugugggacgugcccucccccgccgccacccagaaggcggcccucagcgaggggguguaccggaucaugcagcgcggccuguucgggaagacccaggucggcguggggauccacauggagggcguguuccacacgauguggcacgucacccggggcuccgugaucugccacgagaccgggcgccuggagcccagcugggccgacgugcgcaacgacaugaucuccuacggcgggggcuggcggcucggcgacaagugggacaaggaggaggacguccaggugcuggccaucgagccggggaagaaccccaagcacgugcagaccaagcccggccuguucaagacgcucaccggggagaucggcgccgucacccuggacuucaagcccgggaccagcggcuccccgaucaucaaccgcaagggcaaggugaucgggcuguacggcaacgggguggucacgaagagcggcgacuacguguccgcgaucacccaggccgagcggaucggggagcccgacuacgagguggacgaggacaucuuccgcaagaagcggcucaccaucauggaccugcaccccggcgccggcaagaccaagcgcauccugccgagcaucguccgggaggcccugaagcgccggcuccgcacgcugauccuggcgcccacccgggugguggccgccgagauggaggaggcccuccgcgggcugcccauccgguaccagacccccgccgucaaguccgagcacaccggccgcgagaucguggaccugaugugccacgcgacguucaccacccggcuccugagcagcacccgcgugccgaacuacaaccugaucgucauggacgaggcccacuucacggaccccuccagcguggccgcccggggguacaucuccacccgcgucgagaugggcgaggccgcggccaucuucaugaccgccaccccccccggggccacggacccguucccccagagcaacucccccaucgaggacaucgagcgggagauccccgagcgcagcuggaacaccggcuucgacuggaucaccgacuaccagggcaagaccgugugguucgugccguccaucaaggccgggaacgacaucgcgaacugccuccgcaagagcggcaagaaggucauccagcugucccggaagacguucgacaccgaguaccccaagaccaagcugaccgacugggacuucguggugacgaccgacaucagcgagaugggggccaacuuccgcgccggccgggucaucgacccccgccggugccucaagcccgugauccugaccgacgggccggagcgcgugauccuggccggccccauccccgucacccccgcguccgccgcccagcggcgcggccggaucgggcgcaacccggcccaggaggacgaccaguacguguucagcggcgacccccucaagaacgacgaggaccacgcccacuggacggaggcgaagaugcugcuggacaacaucuacacccccgaggggaucauccccacccucuucggcccggagcgggagaagacccaggccaucgacggcgaguuccgccugcggggggagcagcgcaagacguucguggagcugaugcggcgcggcgaccuccccgucuggcuguccuacaagguggccagcgccgggaucuccuacaaggaccgggaguggugcuucaccggcgagcgcaacaaccagauccuggaggagaacauggagguggagaucuggacccgggagggggagaagaagaagcuccgcccccgguggcuggacgcccgcgucuacgcggaccccauggcccugaaggacuucaaggaguucgccagcggccgcaaguccaucacccucgacauccugaccgagaucgccagccugccgacguaccucuccagccgggccaagcuggcgcuggacaacaucgugaugcuccacaccaccgagcgcggcgggcgggccuaccagcacgcccugaacgagcugcccgagagccucgagacccugaugcugguggcccuccugggcgcgaugacggccgggaucuuccuguucuucaugcagggcaaggggaucggcaagcucuccaugggccugaucaccaucgccgucgccagcgggcugcucuggguggccgagauccagccccaguggaucgcggccuccaucauccuggaguucuuccugauggugcuccugaucccggagcccgagaagcagcgcaccccccaggacaaccagcugaucuacgucauccucaccauccugacgaucaucggccugaucgccgccaacgagauggggcucaucgagaagaccaagaccgacuucggcuucuaccaggugaagaccgagacgaccauccuggacguggaccugcggcccgccagcgcguggacccucuacgccgucgccaccacgauccugaccccgaugcugcgccacaccaucgagaacaccuccgccaaccucagccuggccgcgaucgccaaccaggccgccgugcugauggggcucggcaagggcuggccccugcaccggauggaccugggggugccccuccuggccaugggcugcuacucccaggucaaccccacgacccugaccgcgagccucgugaugcugcuggugcacuacgccaucaucgggccgggccuccaggccaaggccacccgcgaggcgcagaagcggacggccgccggcaucaugaagaaccccaccgucgacgggaucaccgugaucgaccuggagcccaucuccuacgaccccaaguucgagaagcagcugggccaggugaugcuccugguccugugcgccgggcagcuccugcugaugcgcaccacgugggccuucugcgaggugcucacccuggcgaccggcccgauccugacccucugggaggggaaccccggccgguucuggaacacgaccaucgccgugagcaccgccaacaucuuccgcggcuccuaccuggccggggccggccuggcguucagccucaucaagaacgcccagaccccccggcgcgggacgggcaccaccggggagacccugggcgagaaguggaagcggcagcugaacucccucgaccgcaaggaguucgaggaguacaagcggagcggcauccuggaggucgaccgcaccgaggccaaguccgcccugaaggacgggagcaagaucaagcacgccgugucccggggcagcuccaagauccgcuggaucguggagcgcgggauggucaagcccaagggcaaggugguggaccucgggugcggccggggcggguggagcuacuacauggcgacgcugaagaacgucaccgaggugaagggcuacaccaaggggggcccggggcacgaggagcccauccccauggccaccuacggcuggaaccuggugaagcuccacagcggcgucgacguguucuacaagcccacggagcagguggacacccugcugugcgacaucggggaguccagcuccaacccgaccaucgaggagggccgcacccuccggguccugaagaugguggagcccuggcugagcuccaagcccgaguucugcaucaaggugcugaaccccuacaugccgacggucaucgaggagcucgagaagcugcagcgcaagcacgggggcaaccuggugcggugcccccucagccgcaacuccacccacgagauguacugggucagcggcgccuccgggaacaucgugagcuccgugaacaccaccagcaagaugcugcugaaccgguucacgacccgccaccggaagcccaccuacgagaaggacgucgaccucggcgccgggacccgcuccgugagcacggagaccgagaagcccgacaugaccaucaucggccggcgccugcagcggcugcaggaggagcacaaggagaccuggcacuacgaccaggagaacccguaccgcacgugggcguaccacggguccuacgaggcccccagcaccggcuccgccagcuccauggugaacggcgucgugaagcuccugaccaagcccugggacgugaucccgauggucacccagcuggccaugacggacaccacccccuucgggcagcagcggguguucaaggagaagguggacacccgcacgccccagcccaagccgggcacccggauggucaugaccaccacggccaacuggcucugggcgcugcuggggaagaagaagaacccccgccucugcacccgggaggaguucaucagcaaggugcgcagcaacgccgccaucggcgccguguuccaggaggagcagggguggaccuccgccagcgaggcggucaacgacucccgguucugggagcugguggacaaggagcgcgcccugcaccaggagggcaagugcgagagcugcguguacaacaugaugggcaagcgcgagaagaagcucggggaguucggccgggccaaggggucccgcgccaucugguacauguggcugggcgcccgguuccuggaguucgaggcgcucggguuccugaacgaggaccacugguucggccgcgagaacagcugguccggcgucgagggggagggccugcaccggcucggguacauccuggaggagaucgacaagaaggacggcgaccugauguacgccgacgacaccgccggcugggacacgcgcaucaccgaggacgaccuccagaacgaggagcugaucaccgagcagauggccccccaccacaagauccuggcgaaggccaucuucaagcucaccuaccagaacaagguggugaagguccugcggcccaccccgcgcggggccgugauggacaucaucagccggaaggaccagcgcggcuccgggcaggugggcacguacgggcugaacaccuucaccaacauggagguccagcucauccggcagauggaggccgagggcgugaucacccaggacgacaugcagaaccccaagggccugaaggagcgcguggagaaguggcugcgggagugcggggucgaccgccucaagcggauggccaucagcggcgacgacugcguggugaagccccuggacgagcgcuucgggacgucccugcucuuccugaacgacaugggcaagguccggaaggacaucccccagugggagccgagcaagggguggaagaacuggcaggaggugcccuucugcucccaccacuuccacaagaucuucaugaaggacggccgcagccuggugguccccugccggaaccaggacgagcucaucggccgcgcgcgcaucucccagggggccggcuggagccugcgggagaccgccugccuggggaaggccuacgcccagauguggucccucauguacuuccaccgccgggaccugcgccuggcgagcauggccaucugcagcgccgugcccaccgagugguucccgaccucccggacgaccuggagcauccacgcccaccaccaguggaugaccaccgaggacaugcucaagguguggaaccgcgucuggaucgaggacaaccccaacaugaucgacaagacgcccgugcacuccugggaggacauccccuaccugggcaagcgggaggaccuguggugcgggagccucaucggccuguccagccgcgccaccugggcgaagaacauccacaccgccaucacccaggugcggaaccugaucggcaaggaggaguacgucgacuacaugccggugaugaagcgcuacuccgcccccagcgaguccgagggggugcucuga

SEQ ID NO: 10460 - RNA, 9867 nt, Artificial Sequence
  derived and/or modified CDS sequence (opt1) from DENV-4__FJ639737__SS-prME
agcaccaucacccugcucugccugauccccacggugauggccuuccaccuguccacccgcgacggcgagccgcucaugaucgucgccaagcacgagcgggggcgcccccugcuguucaagaccaccgagggcaucaacaagugcacgcucaucgcgauggaccugggggagaugugcgaggacaccgugaccuacaagugcccccugcucaucaacaccgagcccgaggacaucgacugcuggugcaaccugacgagcaccugggugauguacggcaccugcacccaguccggggagcggcgccgggagaagcgcagcgucgcccugacgccgcacuccggcaugggccucgagacccgggccgagaccuggaugagcuccgagggggccuggaagcacgcccagcgcguggagagcuggauccugcggaaccccggcuucgcgcugcucgccggguucauggccuacaugaucggccagaccgggauccagcgcacgguguucuucguccugaugaugcugguggcccccuccuacggcaugcggugcgugggcgucgggaaccgcgacuucguggagggcgugagcgggggcgcgugggucgaccucgugcuggagcacggcgggugcgugaccaccauggcccagggcaagcccacccuggacuucgagcucacgaagaccaccgccaaggaggucgcccugcugcggaccuacugcaucgaggcccucaucuccaacaucacgaccgcgacccgcugcccgacccagggggagcccuaccugaaggaggagcaggaccagcaguacaucugccggcgcgacgugguggaccggggcugggggaacggcugcggccuguucgggaagggcggggucgugacgugcgccaaguucagcugcuccggcaagaucaccgggaaccucgugcagaucgagaaccuggaguacaccgucguggugaccguccacaacggcgacacgcacgccgugggcaacgacaccagcaaccacggggucaccgccaccaucacgccccgcucccccagcguggaggugaagcugccggacuacggcgagcucacccuggacugcgagccccgguccgggaucgacuucaacgagaugauccugaugaagaugaagaagaagaccuggcucguccacaagcagugguuccuggaccugccccuccccuggaccgccggcgcggacaccagcgaggugcacuggaacuacaaggagcgcauggugacguucaaggucccgcacgccaagcggcaggacgugaccgugcuggggucccaggagggcgccaugcacagcgcccuggccggcgcgaccgaggucgacagcggggacggcaaccacauguucgccgggcaccucaagugcaaggugcgcauggagaagcugcgcaucaagggcauguccuacaccaugugcagcggcaaguucuccaucgacaaggagauggccgagacgcagcacgggaccaccguggucaaggugaaguacgagggcgccggggcccccugcaaggugcccaucgagauccgggacgucaacaaggagaagguggugggccgcgucaucagcuccaccccccuggcggagaacacgaacagcgugaccaacaucgagcucgagccgcccuucggggacuccuacaucgugaucggcgucggcaacagcgcccugacccugcacugguuccggaagggguccagcaucggcaagauguucgaguccaccuaccgcggggccaagcggauggccauccucggcgagacggcgugggacuucgggagcgugggcggccuguucaccucccuggggaaggccgugcaccaggucuucggcagcguguacaccaccauguucgggggcguguccuggaugauccgcauccucaucggguuccugguccuguggaucggcacgaacagccggaacaccuccauggccaugaccugcaucgccgugggcgggaucacccuguuccucggcuucacggugcaggccgacauggggugcgucgugagcugguccggccgcgagcugaagugcgggagcggcaucuucguggucgacaacgugcacaccuggaccgagcaguacaaguuccagcccgagagccccgcgcggcuggccuccgccauccucaacgcccacaaggacggcgugugcgggauccgcagcaccacgcggcuggagaacgucauguggaagcagaucaccaacgagcugaacuacgugcucugggagggcgggcacgaccugaccguggucgccggcgacgugaagggcgugcugaccaaggggaagcgcgcgcucacgccgcccgucuccgaccugaaguacagcuggaagaccuggggcaaggccaagaucuucacccccgaggcccggaacuccaccuuccugaucgacgggcccgacacgagcgagugcccgaacgagcgccgggccuggaacucccucgagguggaggacuacggcuucgggauguucaccaccaacaucuggaugaaguuccgcgagggcagcuccgaggugugcgaccaccggcugaugagcgccgcgaucaaggaccagaaggccguccacgccgacaugggcuacuggaucgaguccagcaagaaccagaccuggcagaucgagcgcgccucccugaucgaggugaagacgugccucuggcccaagacccacacccuguggagcaacggggugcuggagucccagaugcucauccccaagagcuacgcgggcccguucucccagcacaacuaccggcagggguacgccacccagaccgucggccccuggcaccuggggaagcuggagaucgacuucggcgagugccccggcacgaccgugaccauccaggaggacugcgaccaccgcgggcccagccuccgcaccacgaccgccagcggcaagcuggugacccaguggugcugccgguccugcaccaugccgccccugcgcuuccucggggaggacggcugcugguacgggauggagauccggccccugagcgagaaggaggagaacauggucaagucccaggugacggccggccagggcaccagcgagaccuucuccauggggcugcucugccugacccuguucgucgaggagugccuccgccggcgcgugacgcggaagcacaugauccuggccguggucaucacccugugcgcgaucauccucggcgggcugaccuggauggaccugcuccgcgcccugaucaugcugggcgacaccaugagcggccggaucgggggccagacgcaccucgccaucauggccguguucaagaugucccccggguacgugcugggcgucuuccugcgcaagcucaccagccgggagaccgcccugauggugaucgggauggcgaugaccacgacccuguccaucccgcacgaccucauggagcugaucgacggcaucagccugggccucauccugcugaagaucgugacccaguucgacgacacccaggucgggacgcucgcccugucccugaccuucauccgcagcaccaugucccucgugauggccuggcggaccaucauggccgugcuguucgucgugacgcugaucccccucugccgcaccagcugccugcagaagcagucccacuggguggagaucaccgcccugauccucggcgcgcaggcccugcccgucuaccugaugacccucaugaagggggccagccggcgcuccuggccccugaacgagggcaucauggccguggggcuggugagccuccugggcuccgcgcugcucaagaacgacgucccgcuggccggccccaugguggccgggggccugcuccuggccgccuacgugaugagcgggagcuccgcggaccugagccucgagaaggccgccuccguccagugggacgagauggccgacaucacgggcagcucccccaucaucgaggugaagcaggacgaggacgggagcuucuccauccgggacguggaggagaccaacaugaucacccugcuggucaagcucgcccugaucaccgugagcggccuguacccccucgcgaucccggugacgaugacccugugguacauguggcaggucaagacccagcgcuccggcgcccugugggacgugcccagccccgccgccacccagaaggccgcgcucuccgaggggguguaccggaucaugcagcgcggccuguucgggaagacccaggucggcguggggauccacaucgagggcguguuccacacgauguggcacgucacccggggcagcgugaucugccacgagaccgggcgccuggagcccuccugggccgacgugcgcaacgacaugaucagcuacggcgggggcuggcggcucggcgacaagugggacaaggaggaggacguccaggugcuggccaucgagccggggaagaaccccaagcacgugcagaccaagcccggccuguucaagacgcucaccggggagaucggcgccgucacccuggacuucaagcccgggaccuccggcagcccgaucaucaaccgcaagggcaaggugaucgggcuguacggcaacgggguggucacgaaguccggcgacuacgugagcgccaucacccaggcggagcggaucggggagcccgacuacgagguggacgaggacaucuuccgcaagaagcggcucaccaucauggaccugcaccccggcgccggcaagaccaagcgcauccugccguccaucguccgggaggcccugaagcgccggcuccgcacgcugauccuggcccccacccgggugguggcggccgagauggaggaggcccuccgcgggcugcccauccgguaccagacccccgccgucaagagcgagcacaccggccgcgagaucguggaccugaugugccacgccacguucaccacccggcuccugagcuccacccgcgugccgaacuacaaccugaucgucauggacgaggcgcacuucacggaccccagcuccguggccgcccggggguacaucagcacccgcgucgagaugggcgaggccgccgcgaucuucaugaccgccaccccccccggggccacggacccguucccccaguccaacagccccaucgaggacaucgagcgggagauccccgagcgcuccuggaacaccggcuucgacuggaucaccgacuaccagggcaagaccgugugguucgugccgagcaucaaggccgggaacgacaucgccaacugccuccgcaaguccggcaagaaggucauccagcugagccggaagacguucgacaccgaguaccccaagaccaagcugaccgacugggacuucguggugacgaccgacaucuccgagaugggggcgaacuuccgcgccggccgggucaucgacccccgccggugccucaagcccgugauccugaccgacgggccggagcgcgugauccuggccggccccauccccgucacccccgccagcgcggcccagcggcgcggccggaucgggcgcaacccggcccaggaggacgaccaguacguguucuccggcgacccccucaagaacgacgaggaccacgcccacuggacggaggccaagaugcugcuggacaacaucuacacccccgaggggaucauccccacccucuucggcccggagcgggagaagacccaggcgaucgacggcgaguuccgccugcggggggagcagcgcaagacguucguggagcugaugcggcgcggcgaccuccccgucuggcugagcuacaagguggccuccgccgggaucagcuacaaggaccgggaguggugcuucaccggcgagcgcaacaaccagauccuggaggagaacauggagguggagaucuggacccgggagggggagaagaagaagcuccgcccccgguggcuggacgcccgcgucuacgccgaccccauggcgcugaaggacuucaaggaguucgccuccggccgcaagagcaucacccucgacauccugaccgagaucgccucccugccgacguaccucagcagccgggccaagcuggcccuggacaacaucgugaugcuccacaccaccgagcgcggcgggcgggcguaccagcacgcccugaacgagcugcccgagucccucgagacccugaugcugguggcccuccugggcgccaugacggcggggaucuuccuguucuucaugcagggcaaggggaucggcaagcucagcaugggccugaucaccaucgccgucgccuccgggcugcucuggguggccgagauccagccccaguggaucgccgcgagcaucauccuggaguucuuccugauggugcuccugaucccggagcccgagaagcagcgcaccccccaggacaaccagcugaucuacgucauccucaccauccugacgaucaucggccugaucgccgccaacgagauggggcucaucgagaagaccaagaccgacuucggcuucuaccaggugaagaccgagacgaccauccuggacguggaccugcggcccgccuccgccuggacccucuacgcggucgccaccacgauccugaccccgaugcugcgccacaccaucgagaacaccagcgccaaccucucccuggccgccaucgcgaaccaggccgccgugcugauggggcucggcaagggcuggccccugcaccggauggaccugggggugccccuccuggccaugggcugcuacagccaggucaaccccacgacccugaccgccucccucgugaugcugcuggugcacuacgcgaucaucgggccgggccuccaggccaaggccacccgcgaggcccagaagcggacggcggccggcaucaugaagaaccccaccgucgacgggaucaccgugaucgaccuggagcccaucagcuacgaccccaaguucgagaagcagcugggccaggugaugcuccugguccugugcgccgggcagcuccugcugaugcgcaccacgugggccuucugcgaggugcucacccuggccaccggcccgauccugacccucugggaggggaaccccggccgguucuggaacacgaccaucgcgguguccaccgccaacaucuuccgcggcagcuaccuggccggggccggccuggccuucucccucaucaagaacgcgcagaccccccggcgcgggacgggcaccaccggggagacccugggcgagaaguggaagcggcagcugaacagccucgaccgcaaggaguucgaggaguacaagcgguccggcauccuggaggucgaccgcaccgaggccaagagcgcccugaaggacggguccaagaucaagcacgccgugagccggggcuccagcaagauccgcuggaucguggagcgcgggauggucaagcccaagggcaaggugguggaccucgggugcggccggggcggguggagcuacuacauggccacgcugaagaacgucaccgaggugaagggcuacaccaaggggggcccggggcacgaggagcccauccccauggcgaccuacggcuggaaccuggugaagcuccacuccggcgucgacguguucuacaagcccaucgagcagguggacacgcugcugugcgacaucggggagagcuccagcaacccgaccaucgaggagggccgcacccuccggguccugaagaugguggagcccuggcuguccagcaagcccgaguucugcaucaaggugcugaaccccuacaugccgaccgucaucgaggagcucgagaagcugcagcgcaagcacgggggcaaccuggugcggugcccccucucccgcaacagcacgcacgagauguacugggucuccggcgccagcgggaacaucguguccagcgugaacaccaccuccaagaugcugcugaaccgguucaccacgcgccaccggaagcccaccuacgagaaggacgucgaccucggcgccgggacccgcagcguguccaccgagacggagaagcccgacaugaccaucaucggccggcgccugcagcggcugcaggaggagcacaaggagaccuggcacuacgaccaggagaacccguaccgcaccugggccuaccacgggagcuacgaggcgcccuccacgggcagcgccuccagcauggugaacggcgucgugaagcuccugaccaagcccugggacgugaucccgauggucacccagcuggccaugaccgacacgacccccuucgggcagcagcggguguucaaggagaagguggacacccgcaccccccagcccaagccgggcacgcggauggucaugaccaccaccgccaacuggcucugggcccugcuggggaagaagaagaacccccgccucugcacgcgggaggaguucaucagcaaggugcgcuccaacgcggccaucggcgccguguuccaggaggagcagggguggaccagcgccuccgaggccgucaacgacagccgguucugggagcugguggacaaggagcgcgcgcugcaccaggagggcaagugcgaguccugcguguacaacaugaugggcaagcgcgagaagaagcucggggaguucggccgggccaaggggagccgcgccaucugguacauguggcugggcgcccgguuccuggaguucgaggcccucggguuccugaacgaggaccacugguucggccgcgagaacuccuggagcggcgucgagggggagggccugcaccggcucggguacauccuggaggagaucgacaagaaggacggcgaccugauguacgcggacgacaccgccggcugggacacccgcaucacggaggacgaccuccagaacgaggagcugaucaccgagcagauggccccccaccacaagauccuggccaaggcgaucuucaagcucaccuaccagaacaagguggugaagguccugcggcccaccccgcgcggggccgugauggacaucaucucccggaaggaccagcgcggcagcgggcaggugggcaccuacgggcugaacacguucaccaacauggagguccagcucauccggcagauggaggccgagggcgugaucacccaggacgacaugcagaaccccaagggccugaaggagcgcguggagaaguggcugcgggagugcggggucgaccgccucaagcggauggccaucuccggcgacgacugcguggugaagccccuggacgagcgcuucgggaccagccugcucuuccugaacgacaugggcaagguccggaaggacaucccccagugggagccguccaagggguggaagaacuggcaggaggugcccuucugcagccaccacuuccacaagaucuucaugaaggacggccgcucccuggugguccccugccggaaccaggacgagcucaucggccgcgcccgcaucagccagggggcgggcuggucccugcgggagacggccugccuggggaaggccuacgcccagauguggagccucauguacuuccaccgccgggaccugcgccuggccagcauggcgaucugcuccgccgugcccaccgagugguucccgaccagccggaccacgugguccauccacgcccaccaccaguggaugaccaccgaggacaugcucaagguguggaaccgcgucuggaucgaggacaaccccaacaugaucgacaagacccccgugcacagcugggaggacauccccuaccugggcaagcgggaggaccuguggugcgggucccucaucggccugagcucccgcgccacgugggccaagaacauccacaccgcgaucacccaggugcggaaccugaucggcaaggaggaguacgucgacuacaugccggugaugaagcgcuacagcgcccccuccgagagcgagggggugcucuga

SEQ ID NO: 10461 - RNA, 9867 nt, Artificial Sequence
  derived and/or modified CDS sequence (opt1) from DENV-4__FJ639738__SS-prME
agcaccaucacccugcucugccugauccccacggugauggccuuccaccuguccacccgcgacggcgagccgcucaugaucgucgccaagcacgagcgggggcgcccccugcuguucaagaccaccgagggcaucaacaagugcacgcucaucgcgauggaccugggggagaugugcgaggacaccgugaccuacaagugcccccugcucgugaacaccgagcccgaggacaucgacugcuggugcaaccugacgagcaccugggucauguacggcaccugcacccaguccggggagcggcgccgggagaagcgcagcguggcccugacgccgcacuccggcaugggccucgagacccgggccgagaccuggaugagcuccgagggggccuggaagcacgcccagcgcguggagagcuggauccugcggaaccccggcuucgcgcugcucgccggguucauggccuacaugaucggccagaccgggauccagcgcacggucuucuucgugcugaugaugcugguggcccccuccuacggcaugcggugcgucggcguggggaaccgcgacuucguggagggcgucagcgggggcgcguggguggaccucgugcuggagcacggcgggugcgucaccaccauggcccagggcaagcccacccuggacuucgagcucacgaagaccaccgccaaggagguggcccugcugcggaccuacugcaucgaggcccucaucuccaacaucacgaccgcgacccgcugcccgacccagggggagcccuaccugaaggaggagcaggaccagcaguacaucugccggcgcgacguggucgaccggggcugggggaacggcugcggccuguucgggaagggcgggguggugacgugcgccaaguucagcugcuccggcaagaucaccgggaaccucguccagaucgagaaccuggaguacaccgugguggucaccgugcacaacggcgacacgcacgccgucggcaacgacaccagcaaccacggggugaccgccaccaucacgccccgcucccccagcguggaggucaagcugccggacuacggcgagcucacccuggacugcgagccccgguccgggaucgacuucaacgagaugauccugaugaagaugaagaagaagaccuggcucgugcacaagcagugguuccuggaccugccccuccccuggaccgccggcgcggacaccagcgaggugcacuggaacuacaaggagcgcauggucacguucaaggugccgcacgccaagcggcaggacgugaccguccuggggucccaggagggcgccaugcacagcgcccuggccggcgcgaccgagguggacagcggggacggcaaccacauguucgccgggcaccucaagugcaaggugcgcauggagaagcugcgcaucaagggcauguccuacaccaugugcagcggcaaguucuccaucgacaaggagauggccgagacgcagcacgggaccaccgucgugaaggugaaguacgagggcgccggggcccccugcaagguccccaucgagauccgggacgugaacaaggagaagguggucggccgcgugaucagcuccaccccccuggcggagaacacgaacagcgugaccaacaucgagcucgagccgcccuucggggacuccuacaucgucaucggcgugggcaacagcgcccugacccugcacugguuccggaagggguccagcaucggcaagauguucgaguccaccuaccgcggggccaagcggauggccauccucggcgagacggcgugggacuucgggagcgugggcggccuguucaccucccuggggaaggccguccaccagguguucggcagcguguacaccaccauguucgggggcgucuccuggaugauccgcauccucaucggguuccuggugcuguggaucggcacgaacagccggaacaccuccauggccaugaccugcaucgccgugggcgggaucacccuguuccucggcuucacgguccaggccgacauggggugcguggugagcugguccggccgcgagcugaagugcgggagcggcaucuucgucguggacaacgugcacaccuggaccgagcaguacaaguuccagcccgagagccccgcgcggcuggccuccgccauccucaacgcccacaaggacggcgucugcgggauccgcagcaccacgcggcuggagaacgugauguggaagcagaucaccaacgagcugaacuacgugcucugggagggcgggcacgaccugaccgucguggccggcgacgugaagggcguccugaccaaggggaagcgcgcgcucacgccgcccguguccgaccugaaguacagcuggaagaccuggggcaaggccaagaucuucacccccgaggcccggaacuccaccuuccugaucgacgggcccgacacgagcgagugcccgaacgagcgccgggccuggaacucccucgagguggaggacuacggcuucgggauguucaccaccaacaucuggaugaaguuccgcgagggcagcuccgaggucugcgaccaccggcugaugagcgccgcgaucaaggaccagaaggccgugcacgccgacaugggcuacuggaucgaguccagcaagaaccagaccuggcagaucgagcgcgccucccugaucgaggugaagacgugccucuggcccaagacccacacccuguggagcaacgggguccuggagucccagaugcucauccccaagagcuacgcgggcccguucucccagcacaacuaccggcagggguacgccacccagaccgugggccccuggcaccuggggaagcuggagaucgacuucggcgagugccccggcacgaccgugaccauccaggaggacugcgaccaccgcgggcccagccuccgcaccacgaccgccagcggcaagcuggucacccaguggugcugccgguccugcaccaugccgccccugcgcuuccucggggaggacggcugcugguacgggauggagauccggccccugagcgagaaggaggagaacauggugaagucccaggucacggccggccagggcaccagcgagaccuucuccauggggcugcucugccugacccuguucguggaggagugccuccgccggcgcgugacgcggaagcacaugauccuggccgucgugaucacccugugcgcgaucauccucggcgggcugaccuggauggaccugcuccgcgcccugaucaugcugggcgacaccaugagcggccggaucgggggccagacgcaccucgccaucauggccguguucaagaugucccccggguacguccugggcguguuccugcgccggcucaccagccgcgagaccgcccugauggugaucgggauggcgaugaccacgacccuguccaucccgcacgaccucauggagcugaucgacggcaucagccugggccucauccugcugaagaucgucacccaguucgacaacacccagguggggacgcucgcccugucccugaccuucauccggagcaccaugucccucgugauggccuggcgcaccaucauggccguccuguucguggugacgcugaucccccucugccggaccagcugccugcagaagcagucccacugggucgagaucaccgcccugauccucggcgcgcaggcccugcccguguaccugaugacccucaugaagggggccagccgccgguccuggccccugaacgagggcaucauggccguggggcuggucagccuccugggcuccgcgcugcucaagaacgacgugccgcuggccggccccaugguggccgggggccugcuccuggccgccuacgucaugagcgggagcuccgcggaccugagccucgagaaggccgccaacgugcagugggacgagauggccgacaucacgggcuccagccccaucaucgaggugaagcaggacgaggacggguccuucagcauccgcgacgucgaggagaccaacaugaucacccugcuggugaagcucgcccugaucaccguguccggccuguacccccucgcgaucccggucacgaugacccugugguacauguggcaggugaagacccagcggagcggcgcccugugggacgugcccucccccgccgccacccagaaggccgcgcucagcgagggggucuaccgcaucaugcagcggggccuguucgggaagacccaggugggcguggggauccacauggagggcgucuuccacacgauguggcacgugacccgcggcuccgugaucugccacgagaccgggcgccuggagcccagcugggccgacguccggaacgacaugaucuccuacggcgggggcuggcgccucggcgacaagugggacaaggaggaggacgugcaggugcuggccgucgagccggggaagaaccccaagcacgugcagaccaagcccggccuguucaagacgaucaccggggagaucggcgccgugacccucgacuucaagcccgggaccagcggcuccccgaucaucaaccggaagggcaaggucaucgggcuguacggcaacgggguggugacgaagagcggcgacuacgucuccgccaucacccaggcggagcgcaucggggagcccgacuacgagguggacgaggacaucuuccggaagaagcgccugaccaucauggaccuccaccccggcgccggcaagaccaagcggauccugccgagcaucgugcgcgaggcccugaagcggcgccugcggacgcucauccuggcccccacccgcgucguggcggccgagauggaggaggcccugcgggggcuccccauccgcuaccagacccccgccgugaaguccgagcacaccggccgggagaucgucgaccugaugugccacgccacguucaccacccgccugcucagcagcacccgggugccgaacuacaaccugaucgucauggacgaggcgcacuucacggaccccuccagcguggccgcccgcggguacaucuccacccggguggagaugggcgaggccgccgcgaucuucaugaccgccaccccccccggggccacggacccguucccccagagcaacucccccaucgaggacaucgagcgcgagauccccgagcgcagcuggaacaccggcuucgacuggaucaccgacuaccagggcaagaccgucugguucgugccguccaucaaggccgggaacgacaucgccaacugccugcggaagagcggcaagaaggugauccagcucucccgcaagacguucgacaccgaguaccccaagaccaagcugaccgacugggacuucgucgugacgaccgacaucagcgagaugggggcgaacuuccgggccggccgcgugaucgacccccggcgcugccugaagcccgucauccucaccgacgggccggagcgggugauccuggccggccccauccccgugacccccgccuccgcggcccagcgccggggccgcaucgggcggaacccggcccaggaggacgaccaguacgucuucagcggcgacccccugaagaacgacgaggaccacgcccacuggacggaggccaagaugcuccuggacaacaucuacacccccgaggggaucauccccacccuguucggcccggagcgcgagaagacccaggcgaucgacggcgaguuccggcuccgcggggagcagcggaagacguucguggagcugaugcgccggggcgaccugcccguguggcucuccuacaaggucgccagcgccgggaucuccuacaaggaccgcgaguggugcuucaccggcgagcggaacaaccagauccuggaggagaacauggagguggagaucuggacccgcgagggggagaagaagaagcugcggccccgcuggcucgacgcccgcguguacgccgaccccauggcgcugaaggacuucaaggaguucgccagcggccggaaguccaucacccuggacauccucaccgagaucgccagccugccgacguaccuguccagccgcgccaagcucgcccuggacaacaucgucaugcugcacaccaccgagcggggcgggcgcgcguaccagcacgcccucaacgagcugcccgagagccuggagacccucaugcugguggcccugcucggcgccaugacggcggggaucuuccuguucuucaugcagggcaaggggaucggcaagcuguccaugggccucaucaccaucgccguggccagcgggcugcugugggucgccgagauccagccccaguggaucgccgcguccaucauccucgaguucuuccugauggugcugcucaucccggagcccgagaagcagcggaccccccaggacaaccagcugaucuacgugauccugaccauccucacgaucaucggccugaucgccgccaacgagauggggcugaucgagaagaccaagaccgacuucggcuucuaccaggucaagaccgagacgaccauccucgacguggaccugcgccccgccagcgccuggacccuguacgcgguggccaccacgauccucaccccgaugcugcggcacaccaucgagaacaccuccgccaaccugagccucgccgccaucgcgaaccaggccgccguccugauggggcugggcaagggcuggccccuccaccgcauggaccugggggugccccugcucgccaugggcugcuacucccaggugaaccccacgacccugaccgccagccuggucaugcuccuggugcacuacgcgaucaucgggccgggccugcaggccaaggccacccgggaggcccagaagcgcacggcggccggcaucaugaagaaccccaccguggacgggaucaccgucaucgaccucgagcccaucuccuacgaccccaaguucgagaagcagcugggccaggugaugcugcucgugcugugcgccgggcagcugcuccugaugcggaccacgugggccuucugcgagguccugacccucgccaccggcccgauccugacccugugggaggggaaccccggccgcuucuggaacacgaccaucgcggugagcaccgccaacaucuuccggggcuccuaccucgccggggccggccuggccuucagccugaucaagaacgcgcagaccccccgccgggggacgggcaccaccggggagacccucggcgagaaguggaagcgccagcugaacucccuggaccggaaggaguucgaggaguacaagcgcagcggcauccucgagguggaccggaccgaggccaaguccgcccugaaggacgggagcaagaucaagcacgccgucucccgcggcagcuccaagauccgcuggaucguggagcgggggauggugaagcccaagggcaaggucguggaccuggggugcggccgcggcggguggagcuacuacauggccacgcucaagaacgugaccgaggucaagggcuacaccaaggggggcccggggcacgaggagcccauccccauggcgaccuacggcuggaaccuggugaagcugcacagcggcguggacgucuucuacaagcccacggagcagguggacacccuccugugcgacaucggggaguccagcuccaacccgaccaucgaggagggccggacccugcgcgugcucaagauggucgagcccuggcugagcuccaagcccgaguucugcaucaaggugcugaaccccuacaugccgacggucaucgaggagcuggagaagcuccagcggaagcacgggggcaaccuggugcgcugcccccugagccggaacuccacccacgagauguacugggugagcggcgccuccgggaacaucgucagcuccgugaacaccaccagcaagaugcuccugaaccgcuucacgacccggcaccgcaagcccaccuacgagaaggacguggaccugggcgccgggacccgguccgucagcacggagaccgagaagcccgacaugaccaucaucggccgccggcuccagcgccugcaggaggagcacaaggagaccuggcacuacgaccaggagaacccguaccggacgugggccuaccacggguccuacgaggcgcccagcaccggcuccgccagcuccauggugaacggcguggucaagcugcucaccaagcccugggacgugaucccgauggugacccagcuggccaugacggacaccacccccuucgggcagcagcgcgucuucaaggagaagguggacacccggacgccccagcccaagccgggcacccgcauggugaugaccaccacggccaacuggcugugggcccuccuggggaagaagaagaacccccggcugugcacccgcgaggaguucaucagcaagguccggagcaacgcggccaucggcgccguguuccaggaggagcagggguggaccuccgccagcgaggccgugaacgacucccgcuucugggagcucgucgacaaggagcgcgcgcugcaccaggagggcaagugcgagagcugcguguacaacaugaugggcaagcgggagaagaagcugggggaguucggccgcgccaaggggucccgggccaucugguacauguggcucggcgcccgcuuccuggaguucgaggcccugggguuccucaacgaggaccacugguucggccgggagaacagcugguccggcguggagggggagggccugcaccgccugggguacauccucgaggagaucgacaagaaggacggcgaccugauguacgcggacgacaccgccggcugggacacgcggaucaccgaggacgaccugcagaacgaggagcucaucaccgagcagauggccccccaccacaagauccuggccaaggcgaucuucaagcugaccuaccagaacaaggucgugaaggugcuccgccccaccccgcggggggccgucauggacaucaucagccgcaaggaccagcggggcuccgggcaggugggcacguacgggcugaacaccuucaccaacauggaggugcagcugauccgccagauggaggccgagggcgucaucacccaggacgacaugcagaaccccaagggccucaaggagcggguggagaaguggcugcgcgagugcgggguggaccggcugaagcgcauggccaucagcggcgacgacugcgucgugaagccccucgacgagcgguucgggacgucccugcuguuccucaacgacaugggcaaggugcgcaaggacaucccccagugggagccgagcaagggguggaagaacuggcaggagguccccuucugcucccaccacuuccacaagaucuucaugaaggacggccggagccugguggugcccugccgcaaccaggacgagcugaucggccgcgcccggaucucccagggggcgggcuggagccuccgcgagaccgccugccuggggaaggccuacgcccagauguggucccugauguacuuccaccggcgcgaccuccggcuggccagcauggcgaucugcagcgccguccccaccgagugguucccgaccucccgcacgaccuggagcauccacgcccaccaccaguggaugaccaccgaggacaugcugaagguguggaaccggguguggaucgaggacaaccccaacaugaucgacaagacgcccguccacuccugggaggacauccccuaccucggcaagcgcgaggaccuguggugcgggagccugaucggccucuccagccgggccaccugggccaagaacauccacaccgcgaucacccaggugcgcaaccugaucggcaaggaggaguacguggacuacaugccggucaugaagcgguacuccgcccccagcgaguccgagggggugcuguga

SEQ ID NO: 10462 - RNA, 9867 nt, Artificial Sequence
  derived and/or modified CDS sequence (opt1) from DENV-4__FJ639739__SS-prME
agcaccaugacccugcucugccugauccccacggccauggccuuccaccuguccacccgcgacggcgagccgcucaugaucguggcgaagcacgagcgggggcgcccccugcuguucaagaccaccgagggcaucaacaagugcacgcucaucgccauggaccugggggagaugugcgaggacaccgucaccuacaagugcccccugcucgugaacaccgagcccgaggacaucgacugcuggugcaaccugacgagcaccugggugauguacggcaccugcacccaguccggggagcggcgccgggagaagcgcagcgucgcccugacgccgcacuccggcaugggccucgagacccgggccgagaccuggaugagcuccgagggggccuggaagcacgcgcagcgcguggagagcuggauccugcggaaccccggcuucgcccugcucgccggguucauggccuacaugaucggccagaccgggauccagcgcacgguguucuucguccugaugaugcugguggcgcccuccuacggcaugcggugcgugggcgucgggaaccgcgacuucguggagggcgugagcgggggcgccugggucgaccucgugcuggagcacggcgggugcgugaccaccauggcccagggcaagcccacccuggacuucgagcucacgaagaccaccgccaaggaggucgcccugcugcggaccuacugcaucgaggcgcucaucuccaacaucacgaccgccacccgcugcccgacccagggggagcccuaccugaaggaggagcaggaccagcaguacaucugccggcgcgacgugguggaccggggcugggggaacggcugcggccuguucgggaagggcggggucgugacgugcgccaaguucagcugcuccggcaagaucaccgggaaccucgugcagaucgagaaccuggaguacaccgucguggugaccguccacaacggcgacacgcacgccgugggcaacgacaccagcaaccacggggucaccgccaccaucacgccccgcucccccagcguggaggugaagcugccggacuacggcgagcucacccuggacugcgagccccgguccgggaucgacuucaacgagaugauccugaugaagaugaagaagaagaccuggcucguccacaagcagugguuccuggaccugccccuccccuggaccgcgggcgccgacaccagcgaggugcacuggaacuacaaggagcgcauggugacguucaaggucccgcacgccaagcggcaggacgugaccgugcuggggucccaggagggcgccaugcacagcgcccuggcgggcgccaccgaggucgacagcggggacggcaaccacauguucgccgggcaccucaagugcaaggugcgcauggagaagcugcgcaucaagggcauguccuacaccaugugcagcggcaaguucuccaucgacaaggagauggccgagacgcagcacgggaccaccguggucaaggugaaguacgagggcgccggggcgcccugcaaggugcccaucgagauccgggacgucaacaaggagaagguggugggccgcgucaucagcuccaccccccuggccgagaacacgaacagcgugaccaacaucgagcucgagccgcccuucggggacuccuacaucgugaucggcgucggcaacagcgcccugacccugcacugguuccggaagggguccagcaucggcaagauguucgaguccaccuaccgcggggccaagcggauggcgauccucggcgagacggccugggacuucgggagcgugggcggccuguucaccucccuggggaaggccgugcaccaggucuucggcagcguguacaccaccauguucgggggcguguccuggaugauccgcauccucaucggguuccugguccuguggaucggcacgaacagccggaacaccuccauggccaugaccugcaucgccgugggcgggaucacccuguuccucggcuucacggugcaggcggacauggggugcgucgugagcugguccggccgcgagcugaagugcgggagcggcaucuucguggucgacaacgugcacaccuggaccgagcaguacaaguuccagcccgagagccccgcccggcuggccuccgccauccucaacgcccacaaggacggcgugugcgggauccgcagcaccacgcggcuggagaacgucauguggaagcagaucaccaacgagcugaacuacgugcucugggagggcgggcacgaccugaccguggucgcgggcgacgugaagggcgugcugaccaaggggaagcgcgcccucacgccgcccgucuccgaccugaaguacagcuggaagaccuggggcaaggccaagaucuucacccccgaggcccggaacuccaccuuccugaucgacgggcccgacacgagcgagugcccgaacgagcgccgggccuggaacucccucgagguggaggacuacggcuucgggauguucaccaccaacaucuggaugaaguuccgcgagggcagcuccgaggugugcgaccaccggcugaugagcgcggccaucaaggaccagaaggccguccacgccgacaugggcuacuggaucgaguccagcaagaaccagaccuggcagaucgagcgcgcgucccugaucgaggugaagacgugccucuggcccaagacccacacccuguggagcaacggggugcuggagucccagaugcucauccccaagagcuacgccggcccguucucccagcacaacuaccggcagggguacgccacccagaccgucggccccuggcaccuggggaagcuggagaucgacuucggcgagugccccggcacgaccgugaccauccaggaggacugcgaccaccgcgggcccagccuccgcaccacgaccgccagcggcaagcuggugacccaguggugcugccgguccugcaccaugccgccccugcgcuuccucggggaggacggcugcugguacgggauggagauccggccccugagcgagaaggaggagaacauggucaagucccaggugacggccggccagggcaccagcgagaccuucuccauggggcugcucugccugacccuguucgucgaggagugccuccgccggcgcgugacgcggaagcacaugauccuggcgguggucaucacccugugcgccaucauccucggcgggcugaccuggauggaccugcuccgcgcccugaucaugcugggcgacaccaugagcggccggaucgggggccagacgcaccucgccaucauggccguguucaagaugucccccggguacgugcugggcgucuuccugcgcaagcucaccagccgggagaccgcgcugauggugaucgggauggccaugaccacgacccuguccaucccgcacgaccucauggagcugaucgacggcaucagccugggccucauccugcugaagaucgugacccaguucgacaacacccaggucgggacgcucgcccugucccugaccuucauccgcagcaccaugucccucgugauggccuggcggaccaucauggccgugcuguucgucgugacgcugaucccccucugccgcaccagcugccugcagaagcagucccacuggguggagaucaccgcgcugauccucggcgcccaggcccugcccgucuaccugaugacccucaugaagggggccagccggcgcuccuggccccugaacgagggcaucauggcgguggggcuggugagccuccugggcuccgcccugcucaagaacgacgucccgcuggccggccccaugguggccgggggccugcuccuggccgcguacgugaugagcgggagcuccgccgaccugagccucgagaaggccgccaacguccagugggacgagauggccgacaucacgggcuccagccccaucaucgaggugaagcaggacgaggacggguccuucagcauccgggacguggaggagaccaacaugaucacccugcuggucaagcucgcgcugaucaccguguccggccuguacccccucgccaucccggugacgaugacccugugguacauguggcaggucaagacccagcgcagcggcgcccugugggacgugcccucccccgccgccacccagaaggcggcccucagcgaggggguguaccggaucaugcagcgcggccuguucgggaagacccaggucggcguggggauccacauggagggcguguuccacacgauguggcacgucacccggggcuccgugaucugccacgagaccgggcgccuggagcccagcugggccgacgugcgcaacgacaugaucuccuacggcgggggcuggcggcucggcgacaagugggacaaggaggaggacguccaggugcuggccaucgagccggggaagaaccccaagcacgugcagaccaagcccggccuguucaagacgcucgccggggagaucggcgcggucacccuggacuucaagcccgggaccagcggcuccccgaucaucaaccgcaagggcaaggugaucgggcuguacggcaacgggguggucaccaagagcggcgacuacguguccgccaucacgcaggccgagcggaucggggagcccgacuacgagguggacgaggacaucuuccgcaagaagcggcucaccaucauggaccugcaccccggcgccggcaagaccaagcgcauccugccgagcaucguccgggaggcgcugaagcgccggcuccgcacccugauccuggcccccacgcgggugguggccgccgagauggaggaggcccuccgcgggcugcccauccgguaccagacccccgcggucaaguccgagcacaccggccgcgagaucguggaccugaugugccacgccaccuucacgacccggcuccugagcagcacccgcgugccgaacuacaaccugaucgucauggacgaggcccacuucaccgaccccuccagcguggccgcccggggguacaucuccacgcgcgucgagaugggcgaggcggccgccaucuucaugaccgccaccccccccggggccaccgacccguucccccagagcaacucccccaucgaggacaucgagcgggagauccccgagcgcagcuggaacacgggcuucgacuggaucaccgacuaccagggcaagaccgugugguucgugccguccaucaaggcggggaacgacaucgccaacugccuccgcaagagcggcaagaaggucauccagcugucccggaagaccuucgacacggaguaccccaagaccaagcugaccgacugggacuucguggugaccacggacaucagcgagaugggggccaacuuccgcgccggccgggucaucgacccccgccggugccucaagcccgugauccugaccgacgggccggagcgcgugauccuggcgggccccauccccgucacccccgccuccgccgcccagcggcgcggccggaucgggcgcaacccggcccaggaggacgaccaguacguguucagcggcgacccccucaagaacgacgaggaccacgcgcacuggaccgaggccaagaugcugcuggacaacaucuacacgcccgaggggaucauccccacccucuucggcccggagcgggagaagacccaggccaucgacggcgaguuccgccugcggggggagcagcgcaagaccuucguggagcugaugcggcgcggcgaccuccccgucuggcuguccuacaagguggccagcgccgggaucuccuacaaggaccgggaguggugcuucacgggcgagcgcaacaaccagauccuggaggagaacauggagguggagaucuggacccgggagggggagaagaagaagcuccgcccccgguggcuggacgcgcgcgucuacgccgaccccauggcccugaaggacuucaaggaguucgccagcggccgcaaguccaucacccucgacauccugaccgagaucgccagccugccgaccuaccucuccagccgggcgaagcuggcccuggacaacaucgugaugcuccacacgaccgagcgcggcgggcgggccuaccagcacgcccugaacgagcugcccgagagccucgagacccugaugcugguggcgcuccugggcgccaugaccgccgggaucuuccuguucuucaugcagggcaaggggaucggcaagcucuccaugggccugaucacgaucgccgucgccagcgggcugcucuggguggcggagauccagccccaguggaucgccgccuccaucauccuggaguucuuccugauggugcuccugaucccggagcccgagaagcagcgcaccccccaggacaaccagcugaucuacgucauccucaccauccugaccaucaucggccugaucgccgccaacgagauggggcucaucgagaagacgaagaccgacuucggcuucuaccaggugaagaccgagaccacgauccuggacguggaccugcggcccgcgagcgccuggacccucuacgccgucgccaccaccauccugacgccgaugcugcgccacaccaucgagaacaccuccgccaaccucagccuggcggccaucgccaaccaggccgccgugcugauggggcucggcaagggcuggccccugcaccggauggaccugggggugccccuccuggcgaugggcugcuacucccaggucaaccccaccacgcugaccgccagccucgugaugcugcuggugcacuacgccaucaucgggccgggccuccaggccaaggcgacccgcgaggcccagaagcggaccgccgccggcaucaugaagaaccccacggucgacgggaucaccgugaucgaccuggagcccaucuccuacgaccccaaguucgagaagcagcugggccaggugaugcuccugguccugugcgccgggcagcuccugcugaugcgcaccaccugggcguucugcgaggugcucacgcuggccaccggcccgauccugacccucugggaggggaaccccggccgguucuggaacaccacgaucgccgugagcaccgccaacaucuuccgcggcuccuaccuggccggggcgggccuggccuucagccucaucaagaacgcccagaccccccggcgcgggaccggcacgaccggggagacccugggcgagaaguggaagcggcagcugaacucccucgaccgcaaggaguucgaggaguacaagcggagcggcauccuggaggucgaccgcaccgaggccaaguccgcccugaaggacgggagcaagaucaagcacgcggugucccggggcagcuccaagauccgcuggaucguggagcgcgggauggucaagcccaagggcaagaucguggaccucgggugcggccggggcggguggagcuacuacauggccacccugaagaacgugacggaggucaagggcuacaccaaggggggcccggggcacgaggagcccauccccauggccaccuacggcuggaaccuggugaagcuccacagcggcguggacgucuucuacaagcccaccgagcagguggacacgcugcugugcgacaucggggaguccagcuccaacccgaccaucgaggagggccgcacccuccgggugcugaagauggucgagcccuggcugagcuccaagcccgaguucugcaucaaggugcugaaccccuacaugccgaccgugaucgaggagcucgagaagcugcagcgcaagcacgggggcaaccugguccggugcccccucagccgcaacuccacgcacgagauguacugggugagcggcgccuccgggaacaucgucagcuccgugaacaccaccagcaagaugcugcugaaccgguucaccacgcgccaccggaagcccaccuacgagaaggacguggaccucggcgcggggacccgcuccgucagcaccgagacggagaagcccgacaugaccaucaucggccggcgccugcagcggcugcaggaggagcacaaggagaccuggcacuacgaccaggagaacccguaccgcaccugggccuaccacggguccuacgaggcccccagcacgggcuccgccagcuccauggugaacggcguggucaagcuccugaccaagcccugggacgugaucccgauggugacccagcuggccaugaccgacacgacccccuucgggcagcagcgggucuucaaggagaagguggacacccgcaccccccagcccaagccgggcacgcggauggugaugaccaccaccgcgaacuggcucugggcccugcuggggaagaagaagaacccccgccucugcacgcgggaggaguucaucagcaagguccgcagcaacgccgccaucggcgccguguuccaggaggagcagggguggaccuccgcgagcgaggccgugaacgacucccgguucugggagcuggucgacaaggagcgcgcccugcaccaggagggcaagugcgagagcugcguguacaacaugaugggcaagcgcgagaagaagcucggggaguucggccgggccaaggggucccgcgccaucugguacauguggcugggcgcgcgguuccuggaguucgaggcccucggguuccugaacgaggaccacugguucggccgcgagaacagcugguccggcguggagggggagggccugcaccggcucggguacauccuggaggagaucgacaagaaggacggcgaccugauguacgccgacgacaccgccggcugggacacccgcaucacggaggacgaccuccagaacgaggagcugaucaccgagcagauggcgccccaccacaagauccuggccaaggccaucuucaagcucaccuaccagaacaaggucgugaaggugcugcggcccaccccgcgcggggccgucauggacaucaucagccggaaggaccagcgcggcuccgggcaggugggcaccuacgggcugaacacguucaccaacauggaggugcagcucauccggcagauggaggccgagggcgucaucacccaggacgacaugcagaaccccaagggccugaaggagcgcguggagaaguggcugcgggagugcgggguggaccgccucaagcggauggcgaucagcggcgacgacugcgucgugaagccccuggacgagcgcuucgggaccucccugcucuuccugaacgacaugggcaaggugcggaaggacaucccccagugggagccgagcaagggguggaagaacuggcaggagguccccuucugcucccaccacuuccacaagaucuucaugaaggacggccgcagccugguggugcccugccggaaccaggacgagcucaucggccgcgcccgcaucucccagggggccggcuggagccugcgggagacggccugccuggggaaggccuacgcgcagauguggucccucauguacuuccaccgccgggaccugcgccuggccagcauggccaucugcagcgccguccccaccgaguggcucccgaccucccggaccacguggagcauccacgcccaccaccaguggaugaccaccgaggacaugcugaagguguggaaccgcguguggaucgaggacaaccccaacaugaucgacaagacccccguccacuccugggaggacauccccuaccugggcaagcgggaggaccucuggugcgggagccugaucggccuguccagccgcgcgacgugggccaagaacauccacaccgccaucacccaggugcggaaccucaucggcaaggaggaguacguggacuacaugccggucaugaagcgcuacuccgcccccagcgaguccgagggggugcuguga

SEQ ID NO: 10463 - RNA, 9867 nt, Artificial Sequence
  derived and/or modified CDS sequence (opt1) from DENV-4__JN819409__SS-prME
agcaccaucacccugcucugccugauccccaccgugauggccuuccaccuguccacccgcgacggcgagccccucaugaucguggccaagcacgagcgggggcggccccugcuguucaagaccaccgagggcaucaacaagugcacccucaucgccauggaccugggggagaugugcgaggacaccgugaccuacaagugcccccugcucgugaacaccgagcccgaggacaucgacugcuggugcaaccugacggccaccugggugauguacgggaccugcacccagagcggggagcggcgccgggagaagcgcuccguggcccugacgccgcacagcggcaugggccucgagacccgggccgagaccuggauguccagcgagggggccuggaagcacgcgcagcgcguggaguccuggauccugcggaaccccggcuucgcccugcucgccggguucauggccuacaugaucggccagaccgggauccagcgcacggucuucuucgugcugaugaugcugguggcgcccagcuacggcaugcggugcgucggcguggggaaccgcgacuucguggagggcgucuccgggggcgccuggguggaccucgugcuggagcacggcgggugcgucaccaccauggcccagggcaagcccacccuggacuucgagcucacgaagaccaccgccaaggagguggcccugcugcggaccuacugcaucgaggcgcucaucagcaacaucacgaccgccacccgcugcccgacccagggggagcccuaccugaaggaggagcaggaccagcaguacaucugccggcgcgacguggucgaccggggcugggggaacggcugcggccuguucgggaagggcgggguggugacgugcgccaaguucuccugcagcggcaagaucaccgggaaccucguccagaucgagaaccuggaguacaccgugguggucaccgugcacaacggcgacacgcacgccgucggcaacgacaccuccaaccacggggugaccgccaccaucacgccccgcagccccuccguggaggucaagcugccggacuacggcgagcucacccuggacugcgagccccggagcgggaucgacuucaacgagaugauccugaugaagaugaagaagaagaccuggcucgugcacaagcagugguuccuggaccugccccuccccuggaccgcgggcgccgacaccuccgaggugcacuggaacuacaaggagcgcauggucacguucaaggugccgcacgccaagcggcaggacgugaccguccuggggagccaggagggcgccaugcacuccgcccuggcgggcgccaccgagguggacagcggggacggcaaccacauguucgccgggcaccucaagugcaaggugcgcauggagaagcugcgcaucaagggcaugagcuacaccaugugcuccggcaaguucagcaucgacaaggagauggccgagacgcagcacgggaccaccgucgugaaggugaaguacgagggcgccggggcgcccugcaagguccccaucgagauccgggacgugaacaaggagaagguggucggccgcgugaucuccagcacgccccuggccgagaacacgaacggggugaccaacaucgagcucgagccgcccuucggcgacuccuacaucgucaucggcguggggaacagcgcccugacccugcacugguuccggaagggcuccagcaucgggaagauguucgaguccaccuaccgcggcgccaagcggauggcgauccucggggagacggccugggacuucggcagcgugggcgggcuguucaccucccugggcaaggccguccaccagguguucgggagcguguacaccaccauguucggcggggucuccuggaugauccgcauccucaucggcuuccuggugcuguggaucggcacgaacagccggaacaccuccauggccaugaccugcaucgccgucggcgggaucacccuguuccucggguucacgguccaggcggacauggggugcguggugagcugguccgggcgcgagcugaagugcggcagcggcaucuucgucguggacaacgugcacaccuggaccgagcaguacaaguuccagcccgagucccccgcccggcuggccagcgccauccucaacgcccacaaggacggggucugcggcauccgcagcaccacgcggcuggagaacgugauguggaagcagaucaccaacgagcugaacuacgugcucugggagggcggccacgaccugaccgucguggcgggcgacgugaaggggguccugaccaagggcaagcgcgcccucacgccgcccguguccgaccugaaguacagcuggaagaccugggggaaggccaagaucuucacccccgaggcccggaacuccaccuuccugaucgacggccccgacacgagcgagugcccgaacgagcgccgggccuggaacucccucgagguggaggacuacggguucggcauguucaccaccaacaucuggaugaaguuccgcgagggcagcuccgaggucugcgaccaccggcugaugagcgcggccaucaaggaccagaaggccgugcacgccgacaugggguacuggaucgaguccagcaagaaccagaccuggcagaucgagcgcgcgucccugaucgaggugaagacgugccucuggcccaagacccacacccuguggagcaacggcguccuggagucccagaugcucauccccaagagcuacgccgggccguucucccagcacaacuaccggcagggcuacgccacccagaccguggggcccuggcaccugggcaagcuggagaucgacuucggcgagugccccgggacgaccgugaccauccaggaggacugcgaccaccgcggccccagccuccgcaccacgaccgccuccgggaagcuggucacccaguggugcugccggagcugcaccaugccgccccugcgcuuccucggcgaggacgggugcugguacggcauggagauccggccccugagcgagaaggaggagaacauggugaagucccaggucacggccggccaggggaccagcgagaccuucuccaugggccugcucugccugacccuguucguggaggagugccuccgccggcgcgugacgcggaagcacaugauccuggcggucaucaucacccugugcgccaucauccucgggggccugaccuggauggaccugcuccgcgcccugaucaugcugggcgacaccaugagcgggcggaucggcgggcagacgcaccucgccaucauggccguguucaagaugucccccggcuacgugcugggggucuuccugcgcaagcucaccagccgggagaccgcgcugauggugaucggcauggccaugaccacgacccuguccaucccgcacgaccucauggagcugaucgacggcaucagccuggggcucauccugcugaagaucgugacccaguucgacaacacccaggucggcacgcucgcccugucccugaccuucauccgcagcaccaugucccucgugauggccuggcggaccaucauggccgugcuguucgucgugacgcugaucccccucugccgcaccagcugccugcagaagcagucccacuggguggagaucaccgcgcugauccucggggcccaggcccugcccgucuaccugaugacccucaugaagggcgccagccggcgcuccuggccccugaacgaggggaucauggcggugggccuggugagccuccugggcuccgcccugcucaagaacgacgucccgcuggccgggcccaugguggccggcgggcugcuccuggccgcguacgugaugagcggcuccagcgccgaccugagccucgagaaggccgccaacguccagugggacgagauggccgacaucacgggguccagccccaucaucgaggugaagcaggacgaggacggcuccuucagcauccgggacguggaggagaccaacaugaucacccugcuggucaagcucgcgcugaucaccguguccggccuguacccccucgccaucccggugacgaugacccugugguacauguggcaggucaagacccagcgcagcggggcccugugggacgugcccucccccgccgccacccagaaggcggcccucagcgagggcguguaccggaucaugcagcgcgggcuguucggcaagacccaggucggggugggcauccacauggagggcguguuccacacgauguggcacgucacccggggguccgugaucugccacgagaccggccgccuggagcccagcugggccgacgugcgcaacgacaugaucuccuacgggggcggcuggcggcucggggacaagugggacaaggaggaggacguccaggugcuggccaucgagccgggcaagaaccccaagcacgugcagaccaagcccgggcuguucaagacgcucaccggcgagaucggggccgucacccuggacuucaagcccggcaccagcggcuccccgaucaucaaccgcaaggggaaggugaucggccuguacgggaacggcguggucaccaagagcggggacuacguguccgcgaucacccaggccgagcggaucggcgagcccgacuacgagguggacgaggacaucuuccgcaagaagcggcucaccaucauggaccugcaccccggcgccgggaagaccaagcgcauccugccgagcaucguccgggaggcccugaagcgccggcuccgcacgcugauccuggcgcccacccgggugguggccgccgagauggaggaggcccuccgcggccugcccauccgguaccagacccccgccgucaaguccgagcacaccgggcgcgagaucguggaccugaugugccacgcgacguucaccacccggcuccugagcuccacccgcgugccgaacuacaaccugaucgucauggacgaggcccacuucacggaccccagcagcguggccgcccggggcuacaucuccacccgcgucgagaugggggaggccgcggccaucuucaugaccgccacgccgcccggcgccacggacccguucccccagagcaacucccccaucgaggacaucgagcgggagauccccgagcgcagcuggaacaccggcuucgacuggaucaccgacuaccaggggaagaccgugugguucgugccguccaucaaggccggcaacgacaucgcgaacugccuccgcaagagcgggaagaaggucauccagcugucccggaagacguucgacaccgaguaccccaagaccaagcugaccgacugggacuucguggugacgaccgacaucagcgagaugggcgccaacuuccgcgccgggcgggucaucgacccccgccggugccucaagcccgugauccugaccgacggcccggagcgcgugauccuggccggccccauccccgucacccccgcguccgccgcccagcggcgcgggcggaucggccgcaacccggcccaggaggacgaccaguacguguucagcggggacccccucaagaacgacgaggaccacgcccacuggacggaggcgaagaugcugcuggacaacaucuacacccccgagggcaucauccccacccucuucggcccggagcgggagaagacccaggccaucgacggggaguuccgccugcggggcgagcagcgcaagacguucguggagcugaugcggcgcggggaccuccccgucuggcuguccuacaagguggccagcgccggcaucuccuacaaggaccgggaguggugcuucaccggggagcgcaacaaccagauccuggaggagaacauggagguggagaucuggacccgggagggcgagaagaagaagcuccgcccccgguggcuggacgcccgcgucuacgcggaccccauggcccugaaggacuucaaggaguucgccagcggccgcaaguccaucacccucgacauccugaccgagaucgccagccugccgacguaccucuccagccgggccaagcuggcgcuggacaacaucgugaugcuccacaccaccgagcgcgggggccgggccuaccagcacgcccugaacgagcugcccgagucccucgagacccugaugcugguggcccuccugggggcgaugacggccggcaucuuccuguucuucaugcaggggaagggcaucggcaagcucagcauggggcugaucaccaucgccgucgccagcggccugcucuggguggccgagauccagccccaguggaucgcggccuccaucauccuggaguucuuccugauggugcuccugaucccggagcccgagaagcagcgcacgccccaggacaaccagcugaucuacgucauccucaccauccugacgaucaucgggcugaucgccgccaacgagaugggccucaucgagaagaccaagaccgacuucggguucuaccaggugaagaccgagacgaccauccuggacguggaccugcggcccgccagcgcguggacccucuacgccgucgccaccacgauccugaccccgaugcugcgccacaccaucgagaacaccuccgccaaccucagccuggccgcgaucgccaaccaggccgccgugcugaugggccucggcaagggguggccccugcaccggauggaccugggcgugccccuccuggccauggggugcuacucccaggucaaccccacgacccugaccgcgagccucgugaugcugcuggugcacuacgccaucaucggcccgggccuccaggccaaggccacccgcgaggcgcagaagcggacggccgccgggaucaugaagaaccccaccgucgacggcaucaccgugaucgaccuggagcccaucuccuacgaccccaaguucgagaagcagcugggccaggugaugcuccugguccugugcgccggccagcuccugcugaugcgcaccacgugggccuucugcgaggugcucacccuggcgaccgggccgauccugacccucugggagggcaaccccggccgguucuggaacacgaccaucgccgugagcaccgccaacaucuuccgcggguccuaccuggccggcgccgggcuggcguucagccucaucaagaacgcccagacgccccggcgcggcacggggaccaccggcgagacccugggcgagaaguggaagcggcagcugaacucccucgaccgcaaggaguucgaggaguacaagcggagcgggauccuggaggucgaccgcaccgaggccaaguccgcccugaaggacggcagcaagaucaagcacgccgugucccgggggagcuccaagauccgcuggaucguggagcgcggcauggucaagcccaaggggaaggugguggaccucggcugcggccgcgggggcuggagcuacuacauggcgacgcugaagaacgucaccgaggugaagggguacaccaagggcgggccgggccacgaggagcccauccccauggccaccuacggcuggaaccuggugaagcuccacuccggggucgacguguucuacaagcccacggagcaggucgacacccugcugugcgacaucggcgagagcagcuccaacccgaccaucgaggaggggcgcacccuccggguccugaagaugguggagcccuggcugagcuccaagcccgaguucugcaucaaggugcugaaccccuacaugccgacggucaucgaggagcucgagaagcugcagcgcaagcacggcggcaaccuggugcggugcccccucagccgcaacuccacccacgagauguacugggucagcggggccuccggcaacaucgugagcuccgugaacaccaccagcaagaugcugcugaaccgguucacgacccgccaccggaagcccaccuacgagaaggacgucgaccucggggccggcacccgcuccgugagcacggagaccgagaagcccgacaugaccaucaucgggcggcgccugcagcggcugcaggaggagcacaaggagaccuggcacuacgaccaggagaacccguaccgcacgugggcguaccacggcuccuacgaggcccccagcaccggcuccgccagcuccauggugaacggggucgugaagcuccugaccaagcccugggacgugaucccgauggucacccagcuggccaugacggacaccacccccuucggccagcagcggguguucaaggagaagguggacacccgcacgccccagcccaagccggggacccggauggucaugaccaccacggccaacuggcucugggcgcugcugggcaagaagaagaacccccgccucugcaccaaggaggaguucaucagcaaggugcgguccaacgccgccaucggggccguguuccaggaggagcagggcuggaccagcgccagcgaggcggucaacgacucccgcuucugggagcugguggacaaggagcgggcccugcaccaggagggcaagugcgagagcugcguguacaacaugauggggaagcgcgagaagaagcucggcgaguucgggcgcgccaagggcucccgggccaucugguacauguggcugggggcccgcuuccuggaguucgaggcgcucggcuuccugaacgaggaccacugguucggccgggagaacagcugguccggggucgagggcgaggggcugcaccgccucggcuacauccuggaggagaucgacaagaaggacggcgaccugauguacgccgacgacaccgccgggugggacacgcggaucaccgaggacgaccuccagaacgaggagcugaucaccgagcagauggcgccccaccacaagauccuggcgaaggccaucuucaagcucaccuaccagaacaagguggugaagguccugcgccccaccccgcggggcgccgugauggacaucaucagccgcaaggaccagcggggguccggccagguggggacguacggccugaacaccuucaccaacauggagguccagcucauccgccagauggaggccgagggcgugaucacccaggacgacaugcagaaccccaaggggcugaaggagcggguggagaaguggcugcgcgagugcggcgucgaccggcucaagcgcauggccaucagcggggacgacugcguggugaagccccuggacgagcgguucggcacgucccuccuguuccugaacgacauggggaagguccgcaaggacaucccccagugggagccgagcaagggcuggaagaacuggcaggaggugcccuucugcucccaccacuuccacaagaucuucaugaaggacggccggagccuggugguccccugccgcaaccaggacgagcucaucgggcgggcgcgcaucucccagggcgccggguggagccugcgcgagaccgccugccugggcaaggccuacgcccagauguggucccucauguacuuccaccggcgcgaccugcggcuggcgagcauggccaucugcuccgccgugcccaccgagugguucccgaccagccgcacgaccuggagcauccacgcccaccaccaguggaugaccaccgaggacaugcucaagguguggaaccgggucuggaucgaggacaaccccaacaugacggacaagacccccauccacuccugggaggacauccccuaccuggggaagcgcgaggaccuguggugcggcagccucaucggccuguccagccgggccaccugggcgaagaacauccacaccgccaucacccaggugcgcaaccugaucgggaaggaggaguacguggacuacaugccggucaugaagcgguacuccgcccccagcgaguccgagggcgugcucuga

SEQ ID NO: 10464 - RNA, 9867 nt, Artificial Sequence
  derived and/or modified CDS sequence (opt1) from DENV-4__FJ639742__SS-prME
agcaccaugacccugcucugccugauccccacggccauggccuuccaccuguccacccgcgacggcgagccgcucaugaucguggcgaagcacgagcgggggcgcccccugcuguucaagaccaccgagggcaucaacaagugcacgcucaucgccauggaccugggggagaugugcgaggacaccgucaccuacaagugcccccugcucgugaacaccgagcccgaggacaucgacugcuggugcaaccugacgagcaccugggugauguacggcaccugcacccaguccggggagcggcgccgggagaagcgcagcgucgcccugacgccgcacuccggcaugggccucgagacccgggccgagaccuggaugagcuccgagggggccuggaagcacgcgcagcgcguggagagcuggauccugcggaaccccggcuucgcccugcucgccggguucauggccuacauggugggccagaccgggauccagcgcacggucuucuucgugcugaugaugcugguggcgcccuccuacggcaugcggugcgucggcguggggaaccgcgacuucguggagggcgucagcgggggcgccuggguggaccucgugcuggagcacggcgggugcgucaccaccauggcccagggcaagcccacccuggacuucgagcucacgaagaccaccgccaaggagguggcccugcugcggaccuacugcaucgaggcgcucaucuccaacaucacgaccgccacccgcugcccgacccagggggagcccuaccugaaggaggagcaggaccagcaguacaucugccggcgcgacguggucgaccggggcugggggaacggcugcggccuguucgggaagggcgggguggugacgugcgccaaguucagcugcuccggcaagaucaccgggaaccucguccagaucgagaaccuggaguacaccgugguggucaccgugcacaacggcgacacgcacgccgucggcaacgacaccagcaaccacggggugaccgccaccaucacgccccgcucccccagcguggaggucaagcugccggacuacggcgagcucacccuggacugcgagccccgguccgggaucgacuucaacgagaugauccugaugaagaugaagaagaagaccuggcucgugcacaagcagugguuccuggaccugccccuccccuggaccgcgggcgccgacaccagcgaggugcacuggaacuacaaggagcgcauggucacguucaaggugccgcacgccaagcggcaggacgugaccguccuggggucccaggagggcgccaugcacagcgcccuggcgggcgccaccgagguggacagcggggacggcaaccacauguucgccgggcaccucaagugcaaggugcgcauggagaagcugcgcaucaagggcauguccuacaccaugugcagcggcaaguucuccaucgacaaggagauggccgagacgcagcacgggaccaccgucgugaaggugaaguacgagggcgccggggcgcccugcaagguccccaucgagauccgggacgugaacaaggagaagguggucggccgcgugaucagcuccaccccccuggccgagaacacgaacagcgugaccaacaucgagcucgagccgcccuucggggacuccuacaucgucaucggcgugggcaacagcgcccugacccugcacugguuccggaagggguccagcaucggcaagauguucgaguccaccuaccgcggggccaagcggauggcgauccucggcgagacggccugggacuucgggagcgugggcggccuguucaccucccuggggaaggccguccaccagguguucggcagcguguacaccaccauguucgggggcgucuccuggaugauccgcauccucaucggguuccuggugcuguggaucggcacgaacagccggaacaccuccauggccaugaccugcaucgccgugggcgggaucacccuguuccucggcuucacgguccaggcggacauggggugcguggugagcugguccggccgcgagcugaagugcgggagcggcaucuucgucguggacaacgugcacaccuggaccgagcaguacaaguuccagcccgagagccccgcccggcuggccuccgccauccucaacgcccacaaggacggcgucugcgggauccgcagcaccacgcggcuggagaacgugauguggaagcagaucaccaacgagcugaacuacgugcucugggagggcgggcacgaccugaccgucguggcgggcgacgugaagggcguccugaccaaggggaagcgcgcccucacgccgcccguguccgaccugaaguacagcuggaagaccuggggcaaggccaagaucuucacccccgaggcccggaacuccaccuuccugaucgacgggcccgacacgagcgagugcccgaacgagcgccgggccuggaacucccucgagguggaggacuacggcuucgggauguucaccaccaacaucuggaugaaguuccgcgagggcagcuccgaggucugcgaccaccggcugaugagcgcggccaucaaggaccagaaggccgugcacgccgacaugggcuacuggaucgaguccagcaagaaccagaccuggcagaucgagcgcgcgucccugaucgaggugaagacgugccucuggcccaagacccacacccuguggagcaacgggguccuggagucccagaugcucauccccaagagcuacgccggcccguucucccagcacaacuaccggcagggguacgccacccagaccgugggccccuggcaccuggggaagcuggagaucgacuucggcgagugccccggcacgaccgugaccauccaggaggacugcgaccaccgcgggcccagccuccgcaccacgaccgccagcggcaagcuggucacccaguggugcugccgguccugcaccaugccgccccugcgcuuccucggggaggacggcugcugguacgggauggagauccggccccugagcgagaaggaggagaacauggugaagucccaggucacggccggccagggcaccagcgagaccuucuccauggggcugcucugccugacccuguucguggaggagugccuccgccggcgcgugacgcggaagcacaugauccuggcggucgugaucacccugugcgccaucauccucggcgggcugaccuggauggaccugcuccgcgcccugaucaugcugggcgacaccaugagcggccggaucgggggccagacgcaccucgccaucauggccguguucaagaugucccccggguacguccugggcguguuccugcgcaagcucaccagccgggagaccgcgcugauggugaucgggauggccaugaccacgacccuguccaucccgcacgaccucauggagcugaucgacggcaucagccugggccucauccugcugaagaucgucacccaguucgacaacacccagguggggacgcucgcccugucccugaccuucauccgcagcaccaugucccucgugauggccuggcggaccaucauggccguccuguucguggugacgcugaucccccucugccgcaccagcugccugcagaagcagucccacugggucgagaucaccgcgcugauccucggcgcccaggcccugcccguguaccugaugacccucaugaagggggccagccggcgcuccuggccccugaacgagggcaucauggcgguggggcuggucagccuccugggcuccgcccugcucaagaacgacgugccgcuggccggccccaugguggccgggggccugcuccuggccgcguacgucaugagcgggagcuccgccgaccugagccucgagaaggccgccuccgugcagugggacgagauggccgacaucacgggcagcucccccaucaucgaggugaagcaggacgaggacgggagcuucuccauccgggacgucgaggagaccaacaugaucacccugcuggugaagcucgcgcugaucaccgugagcggccuguacccccucgccaucccggucacgaugacccugugguacauguggcaggugaagacccagcgcuccggcgcccugugggacgugcccagccccgccgccacccagaaggcggcccucuccgagggggucuaccggaucaugcagcgcggccuguucgggaagacccaggugggcguggggauccacauggagggcgucuuccacacgauguggcacgugacccggggcagcgugaucugccacgagaccgggcgccuggagcccuccugggccgacguccgcaacgacaugaucagcuacggcgggggcuggcggcucggcgacaagugggacaaggaggaggacgugcaggugcuggccaucgagccggggaagaaccccaagcacguccagaccaagcccggccuguucaagacgcucaccggggagaucggcgccgugacccuggacuucaagcccgggaccuccggcagcccgaucaucaaccgcaagggcaaggugaucgggcuguacggcaacggggucgugacgaaguccggcgacuacgugagcgcgaucacccaggccgagcggaucggggagcccgacuacgaggucgacgaggacaucuuccgcaagaagcggcucaccaucauggaccugcaccccggcgccggcaagaccaagcgcauccugccguccaucgugcgggaggcccugaagcgccggcuccgcacgcugauccuggcgcccacccggguggucgccgccgagauggaggaggcccuccgcgggcugcccauccgguaccagacccccgccgugaagagcgagcacaccggccgcgagaucguggaccugaugugccacgcgacguucaccacccggcuccugagcuccacccgcgucccgaacuacaaccugaucgugauggacgaggcccacuucacggaccccagcuccgucgccgcccggggguacaucagcacccgcguggagaugggcgaggccgcggccaucuucaugaccgccaccccccccggggccacggacccguucccccaguccaacagccccaucgaggacaucgagcgggagauccccgagcgcuccuggaacaccggcuucgacuggaucaccgacuaccagggcaagaccgugugguucgucccgagcaucaaggccgggaacgacaucgcgaacugccuccgcaaguccggcaagaaggugauccagcugagccggaagacguucgacaccgaguaccccaagaccaagcugaccgacugggacuucguggucacgaccgacaucuccgagaugggggccaacuuccgcgccggccgggugaucgacccccgccggugccucaagcccgugauccugaccgacgggccggagcgcgucauccuggccggccccauccccgugacccccgcgagcgccgcccagcggcgcggccggaucgggcgcaacccggcccaggaggacgaccaguacguguucuccggcgacccccucaagaacgacgaggaccacgcccacuggacggaggcgaagaugcugcuggacaacaucuacacccccgaggggaucauccccacccucuucggcccggagcgggagaagacccaggccaucgacggcgaguuccgccugcggggggagcagcgcaagacguucgucgagcugaugcggcgcggcgaccuccccguguggcugagcuacaagguggccuccgccgggaucagcuacaaggaccgggaguggugcuucaccggcgagcgcaacaaccagauccuggaggagaacauggaggucgagaucuggacccgggagggggagaagaagaagcuccgcccccgguggcuggacgcccgcguguacgcggaccccauggcccugaaggacuucaaggaguucgccuccggccgcaagagcaucacccucgacauccugaccgagaucgccucccugccgacguaccucagcagccgggccaagcuggcgcuggacaacaucgugaugcuccacaccaccgagcgcggcgggcgggccuaccagcacgcccugaacgagcugcccgagucccucgagacccugaugcuggucgcccuccugggcgcgaugacggccgggaucuuccuguucuucaugcagggcaaggggaucggcaagcucagcaugggccugaucaccaucgccguggccuccgggcugcucuggguggccgagauccagccccaguggaucgcggccagcaucauccuggaguucuuccugaugguccuccugaucccggagcccgagaagcagcgcaccccccaggacaaccagcugaucuacgugauccucaccauccugacgaucaucggccugaucgccgccaacgagauggggcucaucgagaagaccaagaccgacuucggcuucuaccaggugaagaccgagacgaccauccuggacgucgaccugcggcccgccuccgcguggacccucuacgccguggccaccacgauccugaccccgaugcugcgccacaccaucgagaacaccagcgccaaccucucccuggccgcgaucgccaaccaggccgccgugcugauggggcucggcaagggcuggccccugcaccggauggaccugggggucccccuccuggccaugggcugcuacagccaggugaaccccacgacccugaccgcgucccucgugaugcugcugguccacuacgccaucaucgggccgggccuccaggccaaggccacccgcgaggcgcagaagcggacggccgccggcaucaugaagaaccccaccguggacgggaucaccgugaucgaccuggagcccaucagcuacgaccccaaguucgagaagcagcugggccaggucaugcuccuggugcugugcgccgggcagcuccugcugaugcgcaccacgugggccuucugcgaggugcucacccuggcgaccggcccgauccugacccucugggaggggaaccccggccgguucuggaacacgaccaucgccgucuccaccgccaacaucuuccgcggcagcuaccuggccggggccggccuggcguucucccucaucaagaacgcccagaccccccggcgcgggacgggcaccaccggggagacccugggcgagaaguggaagcggcagcugaacagccucgaccgcaaggaguucgaggaguacaagcgguccggcauccuggagguggaccgcaccgaggccaagagcgcccugaaggacggguccaagaucaagcacgccgugagccggggcuccagcaagauccgcuggaucgucgagcgcgggauggugaagcccaagggcaagguggucgaccucgggugcggccggggcggguggagcuacuacauggcgacgcugaagaacgugaccgaggugaagggcuacaccaaggggggcccggggcacgaggagcccauccccauggccaccuacggcuggaaccuggucaagcuccacuccggcguggacguguucuacaagcccacggagcaggucgacacccugcugugcgacaucggggagagcuccagcaacccgaccaucgaggagggccgcacccuccgggugcugaagaugguggagcccuggcuguccagcaagcccgaguucugcaucaagguccugaaccccuacaugccgacggugaucgaggagcucgagaagcugcagcgcaagcacgggggcaaccugguccggugcccccucucccgcaacagcacccacgagauguacuggguguccggcgccagcgggaacaucguguccagcgucaacaccaccuccaagaugcugcugaaccgguucacgacccgccaccggaagcccaccuacgagaaggacguggaccucggcgccgggacccgcagcguguccacggagaccgagaagcccgacaugaccaucaucggccggcgccugcagcggcugcaggaggagcacaaggagaccuggcacuacgaccaggagaacccguaccgcacgugggcguaccacgggagcuacgaggcccccuccaccggcagcgccuccagcauggucaacggcguggugaagcuccugaccaagcccugggacgucaucccgauggugacccagcuggccaugacggacaccacccccuucgggcagcagcggguguucaaggagaaggucgacacccgcacgccccagcccaagccgggcacccggauggugaugaccaccacggccaacuggcucugggcgcugcuggggaagaagaagaacccccgccucugcacccgggaggaguucaucagcaaggugcgcuccaacgccgccaucggcgccgucuuccaggaggagcagggguggaccagcgccuccgaggcggugaacgacagccgguucugggagcugguggacaaggagcgcgcccugcaccaggagggcaagugcgaguccugcgucuacaacaugaugggcaagcgcgagaagaagcucggggaguucggccgggccaaggggagccgcgccaucugguacauguggcugggcgcccgguuccuggaguucgaggcgcucggguuccugaacgaggaccacugguucggccgcgagaacuccuggagcggcguggagggggagggccugcaccggcucggguacauccuggaggagaucgacaagaaggacggcgaccugauguacgccgacgacaccgccggcugggacacgcgcaucaccgaggacgaccuccagaacgaggagcugaucaccgagcagauggccccccaccacaagauccuggcgaaggccaucuucaagcucaccuaccagaacaagguggucaaggugcugcggcccaccccgcgcggggccgugauggacaucaucucccggaaggaccagcgcggcagcgggcaggucggcacguacgggcugaacaccuucaccaacauggaggugcagcucauccggcagauggaggccgagggcgugaucacccaggacgacaugcagaaccccaagggccugaaggagcgcgucgagaaguggcugcgggagugcgggguggaccgccucaagcggauggccaucuccggcgacgacugcguggucaagccccuggacgagcgcuucgggacgagccugcucuuccugaacgacaugggcaaggugcggaaggacaucccccagugggagccguccaagggguggaagaacuggcaggaggugcccuucugcagccaccacuuccacaagaucuucaugaaggacggccgcucccuggucgugcccugccggaaccaggacgagcucaucggccgcgcgcgcaucagccagggggccggcuggucccugcgggagaccgccugccuggggaaggccuacgcccagauguggagccucauguacuuccaccgccgggaccugcgccuggcgagcauggccaucugcuccgccgugcccaccgagugguucccgaccagccggacgaccugguccauccacgcccaccaccaguggaugaccaccgaggacaugcucaaggucuggaaccgcguguggaucgaggacaaccccaacaugaucgacaagacgcccgugcacagcugggaggacauccccuaccugggcaagcgggaggaccuguggugcgggucccucaucggccugagcucccgcgccaccugggcgaagaacauccacaccgccaucacccagguccggaaccugaucggcaaggaggaguacguggacuacaugccggugaugaagcgcuacagcgcccccuccgagagcgaggggguccucuga

SEQ ID NO: 10465 - RNA, 9867 nt, Artificial Sequence
  derived and/or modified CDS sequence (opt1) from DENV-4__FJ639745__SS-prME
agcaccaugacccugcucugccugauccccacggccauggccuuccaccuguccacccgcgacggcgagccgcucaugaucguggcgaagcacgagcgggggcgcccccugcuguucaagaccaccgagggcaucaacaagugcacgcucaucgccauggaccugggggagaugugcgaggacaccgucaccuacaagugcccccugcucgugaacaccgagcccgaggacaucgacugcuggugcaaccugacgagcaccugggugauguacggcaccugcacccaguccggggagcggcgccgggagaagcgcagcgucgcccugacgccgcacuccggcaugggccucgagacccgggccgagaccuggaugagcuccgagggggccuggaagcacgcgcagcgcguggagagcuggauccugcggaaccccggcuucgcccugcucgccggguucauggccuacaugaucggccagaccgggauccagcgcacgguguucuucguccugaugaugcugguggcgcccuccuacggcaugcggugcgugggcgucgggaaccgcgacuucguggagggcgugagcgggggcgccugggucgaccucgugcuggagcacggcgggugcgugaccaccauggcccagggcaagcccacccuggacuucgagcucacgaagaccaccgccaaggaggucgcccugcugcggaccuacugcaucgaggcgcucaucuccaacaucacgaccgccacccgcugcccgacccagggggagcccuaccugaaggaggagcaggaccagcaguacaucugccggcgcgacgugguggaccggggcugggggaacggcugcggccuguucgggaagggcggggucgugacgugcgccaaguucagcugcuccggcaagaucaccgggaaccucgugcagaucgagaaccuggaguacaccgucguggugaccguccacaacggcgacacgcacgccgugggcaacgacaccagcaaccacggggucaccgccaccaucacgccccgcucccccagcguggaggugaagcugccggacuacggcgagcucacccuggacugcgagccccgguccgggaucgacuucaacgagaugauccugaugaagaugaagaagaagaccuggcucguccacaagcagugguuccuggaccugccccuccccuggaccgcgggcgccgacaccagcgaggugcacuggaacuacaaggagcgcauggugacguucaaggucccgcacgccaagcggcaggacgugaccgugcuggggucccaggagggcgccaugcacagcgcccuggcgggcgccaccgaggucgacagcggggacggcaaccacauguucgccgggcaccucaagugcaaggugcgcauggagaagcugcgcaucaagggcauguccuacaccaugugcagcggcaaguucuccaucgacaaggagauggccgagacgcagcacgggaccaccguggucaaggugaaguacgagggcgccggggcgcccugcaaggugcccaucgagauccgggacgucaacaaggagaagguggugggccgcgucaucagcuccaccccccuggccgagaacacgaacagcgugaccaacaucgagcucgagccgcccuucggggacuccuacaucgugaucggcgucggcaacagcgcccugacccugcacugguuccggaagggguccagcaucggcaagauguucgaguccaccuaccgcggggccaagcggauggcgauccucggcgagacggccugggacuucgggagcgugggcggccuguucaccucccuggggaaggccgugcaccaggucuucggcagcguguacaccaccauguucgggggcguguccuggaugauccgcauccucaucgggcugcugguccuguggaucggcacgaacagccggaacaccuccauggccaugaccugcaucgccgugggcgggaucacccucuuccugggcuucacggugcaggcggacauggggugcgucgugagcugguccggccgcgagcugaagugcgggagcggcaucuucguggucgacaacgugcacaccuggaccgagcaguacaaguuccagcccgagagccccgcccggcucgccuccgccauccugaacgcccacaaggacggcgugugcgggauccgcagcaccacgcggcuggagaacgucauguggaagcagaucaccaacgagcucaacuacgugcugugggagggcgggcacgaccugaccguggucgcgggcgacgugaagggcgugcucaccaaggggaagcgcgcccugacgccgcccgucuccgaccugaaguacagcuggaagaccuggggcaaggccaagaucuucacccccgaggcccggaacuccaccuuccucaucgacgggcccgacacgagcgagugcccgaacgagcgccgggccuggaacucccuggagguggaggacuacggcuucgggauguucaccaccaacaucuggaugaaguuccgcgagggcagcuccgaggugugcgaccaccggcugaugagcgcggccaucaaggaccagaaggccguccacgccgacaugggcuacuggaucgaguccagcaagaaccagaccuggcagaucgagcgcgcgucccucaucgaggugaagacgugccuguggcccaagacccacacccuguggagcaacggggugcucgagucccagaugcugauccccaagagcuacgccggcccguucucccagcacaacuaccggcagggguacgccacccagaccgucggccccuggcaccuggggaagcucgagaucgacuucggcgagugccccggcacgaccgugaccauccaggaggacugcgaccaccgcgggcccagccugcgcaccacgaccgccagcggcaagcuggugacccaguggugcugccgguccugcaccaugccgccccuccgcuuccugggggaggacggcugcugguacgggauggagauccggccccugagcgagaaggaggagaacauggucaagucccaggugacggccggccagggcaccagcgagaccuucuccauggggcuccugugccugacccucuucgucgaggagugccugcgccggcgcgugacgcggaagcacaugauccuggcgguggucaucacccucugcgccaucauccugggcgggcugaccuggauggaccuccugcgcgcccugaucaugcucggcgacaccaugagcggccggaucgggggccagacgcaccuggccaucauggccguguucaagaugucccccggguacgugcugggcgucuuccuccgcaagcugaccagccgggagaccgcgcugauggugaucgggauggccaugaccacgacccucuccaucccgcacgaccugauggagcugaucgacggcaucagccucggccugauccugcucaagaucgugacccaguucgacaacacccaggucgggacgcuggcccugucccucaccuucauccgcagcaccaugucccuggugauggccuggcggaccaucauggccgugcuguucgucgugacgcucaucccccugugccgcaccagcugccugcagaagcagucccacuggguggagaucaccgcgcucauccugggcgcccaggcccugcccgucuaccucaugacccugaugaagggggccagccggcgcuccuggccccugaacgagggcaucauggcgguggggcucgugagccugcugggcuccgcccuccugaagaacgacgucccgcuggccggccccaugguggccgggggccuccugcuggccgcguacgugaugagcgggagcuccgccgaccucagccuggagaaggccgccaacguccagugggacgagauggccgacaucacgggcuccagccccaucaucgaggugaagcaggacgaggacggguccuucagcauccgggacguggaggagaccaacaugaucacccugcucgucaagcuggcgcugaucaccguguccggccucuacccccuggccaucccggugacgaugacccugugguacauguggcaggucaagacccagcgcagcggcgcccucugggacgugcccucccccgccgccacccagaaggcggcccugagcgaggggguguaccggaucaugcagcgcggccuguucgggaagacccaggucggcguggggauccacauggagggcguguuccacacgauguggcacgucacccggggcuccgugaucugccacgagaccgggcgccucgagcccagcugggccgacgugcgcaacgacaugaucuccuacggcgggggcuggcggcugggcgacaagugggacaaggaggaggacguccaggugcuggccaucgagccggggaagaaccccaagcacgugcagaccaagcccggccucuucaagacgcugaccggggagaucggcgccgucacccuggacuucaagcccgggaccagcggcuccccgaucaucaaccgcaagggcaaggugaucgggcucuacggcaacgggguggucacgaagagcggcgacuacguguccgcgaucacccaggccgagcggaucggggagcccgacuacgagguggacgaggacaucuuccgcaagaagcggcugaccaucauggaccugcaccccggcgccggcaagaccaagcgcauccugccgagcaucguccgggaggcccucaagcgccggcugcgcacgcugauccucgcgcccacccgggugguggccgccgagauggaggaggcccugcgcgggcugcccauccgguaccagacccccgccgucaaguccgagcacaccggccgcgagaucguggaccucaugugccacgcgacguucaccacccggcugcugagcagcacccgcgugccgaacuacaaccucaucgucauggacgaggcccacuucacggaccccuccagcguggccgcccggggguacaucuccacccgcgucgagaugggcgaggccgcggccaucuucaugaccgccaccccccccggggccacggacccguucccccagagcaacucccccaucgaggacaucgagcgggagauccccgagcgcagcuggaacaccggcuucgacuggaucaccgacuaccagggcaagaccgugugguucgugccguccaucaaggccgggaacgacaucgcgaacugccugcgcaagagcggcaagaaggucauccagcugucccggaagacguucgacaccgaguaccccaagaccaagcucaccgacugggacuucguggugacgaccgacaucagcgagaugggggccaacuuccgcgccggccgggucaucgacccccgccggugccugaagcccgugauccugaccgacgggccggagcgcgugauccucgccggccccauccccgucacccccgcguccgccgcccagcggcgcggccggaucgggcgcaacccggcccaggaggacgaccaguacguguucagcggcgacccccugaagaacgacgaggaccacgcccacuggacggaggcgaagaugcugcucgacaacaucuacacccccgaggggaucauccccacccuguucggcccggagcgggagaagacccaggccaucgacggcgaguuccgccugcggggggagcagcgcaagacguucguggagcucaugcggcgcggcgaccugcccgucuggcuguccuacaagguggccagcgccgggaucuccuacaaggaccgggaguggugcuucaccggcgagcgcaacaaccagauccucgaggagaacauggagguggagaucuggacccgggagggggagaagaagaagcugcgcccccgguggcuggacgcccgcgucuacgcggaccccauggcccucaaggacuucaaggaguucgccagcggccgcaaguccaucacccuggacauccugaccgagaucgccagccucccgacguaccuguccagccgggccaagcuggcgcucgacaacaucgugaugcugcacaccaccgagcgcggcgggcgggccuaccagcacgcccugaacgagcuccccgagagccuggagacccugaugcucguggcccugcugggcgcgaugacggccgggaucuuccucuucuucaugcagggcaaggggaucggcaagcuguccaugggccugaucaccaucgccgucgccagcgggcuccuguggguggccgagauccagccccaguggaucgcggccuccaucauccuggaguucuuccucauggugcugcugaucccggagcccgagaagcagcgcaccccccaggacaaccagcucaucuacgucauccugaccauccugacgaucaucggccucaucgccgccaacgagauggggcugaucgagaagaccaagaccgacuucggcuucuaccaggugaagaccgagacgaccauccuggacguggaccuccggcccgccagcgcguggacccuguacgccgucgccaccacgauccugaccccgaugcuccgccacaccaucgagaacaccuccgccaaccugagccuggccgcgaucgccaaccaggccgccgugcucauggggcugggcaagggcuggccccugcaccggauggaccucggggugccccugcuggccaugggcugcuacucccaggucaaccccacgacccucaccgcgagccuggugaugcugcucgugcacuacgccaucaucgggccgggccugcaggccaaggccacccgcgaggcgcagaagcggacggccgccggcaucaugaagaaccccaccgucgacgggaucaccgugaucgaccuggagcccaucuccuacgaccccaaguucgagaagcagcucggccaggugaugcugcugguccucugcgccgggcagcugcugcucaugcgcaccacgugggccuucugcgaggugcugacccuggcgaccggcccgauccucacccugugggaggggaaccccggccgguucuggaacacgaccaucgccgugagcaccgccaacaucuuccgcggcuccuaccuggccggggccggccucgcguucagccugaucaagaacgcccagaccccccggcgcgggacgggcaccaccggggagacccugggcgagaaguggaagcggcagcucaacucccuggaccgcaaggaguucgaggaguacaagcggagcggcauccuggaggucgaccgcaccgaggccaaguccgcccucaaggacgggagcaagaucaagcacgccgugucccggggcagcuccaagauccgcuggaucguggagcgcgggauggucaagcccaagggcaaggugguggaccuggggugcggccggggcggguggagcuacuacauggcgacgcugaagaacgucaccgaggugaagggcuacaccaaggggggcccggggcacgaggagcccauccccauggccaccuacggcuggaaccucgugaagcugcacagcggcgucgacguguucuacaagcccacggagcagguggacacccugcucugcgacaucggggaguccagcuccaacccgaccaucgaggagggccgcacccugcggguccugaagaugguggagcccuggcugagcuccaagcccgaguucugcaucaaggugcucaaccccuacaugccgacggucaucgaggagcuggagaagcugcagcgcaagcacgggggcaaccucgugcggugcccccugagccgcaacuccacccacgagauguacugggucagcggcgccuccgggaacaucgugagcuccgugaacaccaccagcaagaugcugcucaaccgguucacgacccgccaccggaagcccaccuacgagaaggacgucgaccugggcgccgggacccgcuccgugagcacggagaccgagaagcccgacaugaccaucaucggccggcgccugcagcggcuccaggaggagcacaaggagaccuggcacuacgaccaggagaacccguaccgcacgugggcguaccacggguccuacgaggcccccagcaccggcuccgccagcuccauggugaacggcgucgugaagcugcugaccaagcccugggacgugaucccgauggucacccagcucgccaugacggacaccacccccuucgggcagcagcggguguucaaggagaagguggacacccgcacgccccagcccaagccgggcacccggauggucaugaccaccacggccaacuggcugugggcgcugcucgggaagaagaagaacccccgccugugcacccgggaggaguucaucagcaaggugcgcagcaacgccgccaucggcgccguguuccaggaggagcagggguggaccuccgccagcgaggcggucaacgacucccgguucugggagcugguggacaaggagcgcgcccuccaccaggagggcaagugcgagagcugcguguacaacaugaugggcaagcgcgagaagaagcugggggaguucggccgggccaaggggucccgcgccaucugguacauguggcugggcgcccgguuccucgaguucgaggcgcugggguuccugaacgaggaccacugguucggccgcgagaacagcugguccggcgucgagggggagggccuccaccggcugggguacauccuggaggagaucgacaagaaggacggcgaccucauguacgccgacgacaccgccggcugggacacgcgcaucaccgaggacgaccugcagaacgaggagcugaucaccgagcagauggccccccaccacaagauccucgcgaaggccaucuucaagcugaccuaccagaacaagguggugaagguccugcggcccaccccgcgcggggccgugauggacaucaucagccggaaggaccagcgcggcuccgggcaggugggcacguacgggcucaacaccuucaccaacauggagguccagcugauccggcagauggaggccgagggcgugaucacccaggacgacaugcagaaccccaagggccugaaggagcgcguggagaaguggcuccgggagugcggggucgaccgccugaagcggauggccaucagcggcgacgacugcguggugaagccccuggacgagcgcuucgcgacgucccuccuguuccugaacgacauggggaagguccggaaggacaucccccagugggagccgagcaagggcuggaagaacuggcaggaggugcccuucugcucccaccacuuccacaagaucuucaugaaggacgggcgcagccucgugguccccugccggaaccaggacgagcugaucggccgcgcccgcaucucccagggcgccggguggagccugcgggagaccgccugccucggcaaggccuacgcgcagauguggucccugauguacuuccaccgccgggaccugcgccucgccagcauggccaucugcagcgccgugcccaccgagugguucccgaccucccggacgaccuggagcauccacgcccaccaccaguggaugaccaccgaggacaugcugaagguguggaaccgcgucuggaucgaggacaaccccaacaugaucgacaagacgcccgugcacuccugggaggacauccccuaccuggggaagcgggaggaccucuggugcggcagccugaucgggcuguccagccgcgcgaccugggccaagaacauccacaccgccaucacccaggugcggaaccucaucggcaaggaggaguacgucgacuacaugccggugaugaagcgcuacuccgcccccagcgaguccgagggcgugcuguga

SEQ ID NO: 10466 - RNA, 9867 nt, Artificial Sequence
  derived and/or modified CDS sequence (opt1) from DENV-4__FJ850095__SS-prME
agcaccaucacccugcucugccugauccccacggugauggccuuccaccuguccacccgcgacggcgagccgcucaugaucgucgccaagcacgagcgggggcgcccccugcuguucaagaccaccgagggcaucaacaagugcacgcucaucgcgauggaccugggggagaugugcgaggacaccgugaccuacaagugcccccugcucgugaacaccgagcccgaggacaucgacugcuggugcaaccugacgagcaccugggucauguacggcaccugcacccaguccggggagcggcgccgggagaagcgcagcguggcccugacgccgcacuccggcaugggccucgagacccgggccgagaccuggaugagcuccgagggggccuggaagcacgcccagcgcguggagagcuggauccugcggaaccccggcuucgcgcugcucgccggguucauggccuacaugaucggccagaccgggauccagcgcacggucuucuucgugcugaugaugcugguggcccccuccuacggcaugcggugcgucggcguggggaaccgcgacuucguggagggcgucagcgggggcgcguggguggaccucgugcuggagcacggcgggugcgucaccaccauggcccagggcaagcccacccuggacuucgagcucacgaagaccaccgccaaggagguggcccugcugcggaccuacugcaucgaggcccucaucuccaacaucacgaccgcgacccgcugcccgacccagggggagcccuaccugaaggaggagcaggaccagcaguacaucugccggcgcgacguggucgaccggggcugggggaacggcugcggccuguucgggaagggcgggguggugacgugcgccaaguucagcugcuccggcaagaucaccgggaaccucguccagaucgagaaccuggaguacaccgugguggucaccgugcacaacggcgacacgcacgccgucggcaacgacaccagcaaccacggggugaccgccaccaucacgccccgcucccccagcguggaggucaagcugccggacuacggcgagcucacccuggacugcgagccccgguccgggaucgacuucaacgagaugauccugaugaagaugaagaagaagaccuggcucgugcacaagcagugguuccuggaccugccccuccccuggaccaccggcgccgacacgagcgaggugcacuggaacuacaaggagcgcauggucaccuucaaggugccgcacgcgaagcggcaggacgugaccguccuggggucccaggagggcgccaugcacagcgcccuggccggcgccaccgagguggacagcggggacggcaaccacauguucgcggggcaccucaagugcaaggugcgcauggagaagcugcgcaucaagggcauguccuacacgaugugcagcggcaaguucuccaucgacaaggagauggccgagacccagcacgggaccaccgucgugaaggugaaguacgagggcgccggggcccccugcaagguccccaucgagauccgggacgugaacaaggagaagguggucggccgcgugaucagcgccacgccccuggcggagaacaccaacuccgugaccaacaucgagcucgagccgcccuucggggacagcuacaucgucaucggcgugggcaacuccgcccugacccugcacugguuccggaaggggagcuccaucggcaagauguucgagagcacguaccgcggggccaagcggauggccauccucggcgagaccgcgugggacuucggguccgugggcggccuguucaccagccuggggaaggccguccaccagguguucggcuccguguacaccacgauguucgggggcgucagcuggaugauccgcauccucaucggguuccuggugcuguggaucggcaccaacucccggaacaccagcauggccaugaccugcaucgccgugggcgggaucacgcuguuccucggcuucaccguccaggccgacauggggugcgugguguccuggagcggccgcgagcugaagugcggguccggcaucuucgucguggacaacgugcacaccuggaccgagcaguacaaguuccagcccgagagccccgcgcggcuggccagcgccauccucaacgcccacaaggacggcgucugcgggauccgcuccacgacccggcuggagaacgugauguggaagcagaucaccaacgagcugaacuacgugcucugggagggcgggcacgaccugaccgucguggccggcgacgugaagggcguccugacgaaggggaagcgcgcgcucaccccgcccgccagcgaccugaaguacuccuggaagaccuggggcaaggccaagaucuucacccccgaggcccggaacagcacguuccugaucgacgggcccgacaccuccgagugcccgaacgagcgccgggccuggaacagcuucgagguggaggacuacggcuucgggauguucaccaccaacaucuggaugaaguuccgcgagggcuccagcgaggugugcgaccaccggcucauguccgcggccaucaaggaccagaaggccguccacgccgacaugggcuacuggaucgagagcuccaagaaccagacguggcagaucgagcgcgcgagccugaucgaggugaagaccugccuguggcccaagacccacacccucugguccaacggggugcuggagagccagaugcugauccccaaguccuacgccggcccguucagccagcacaacuaccggcagggguacgccacccagacggucggccccuggcaccucgggaagcuggagaucgacuucggcgagugccccggcaccaccgugaccauccaggaggacugcgaccaccgcgggcccucccugcgcacgaccaccgccagcggcaagcucgugacccaguggugcugccggagcugcacgaugccgccccugcgcuuccugggggaggacggcugcugguacgggauggagauccggccccucuccgagaaggaggagaacauggucaagagccaggugaccgccggccagggcaccuccgagaccuucagcauggggcugcugugccucacgcuguucgucgaggagugccugcgccggcgcgugacccggaagcacaugauccucgcgguggucaucacccugugcgccaucauccugggcgggcucaccuggauggaccugcugcgcgcccucaucaugcugggcgacacgauguccggccggaucgggggccagacccaccuggccaucauggccguguucaagaugagccccggguacgugcucggcgucuuccugcgcaagcugaccucccgggagaccgcgcucauggugaucgggauggccaugacgaccacccugagcaucccgcacgaccugauggagcucaucgacggcaucucccugggccugauccuccugaagaucgugacccaguucgacaacacgcaggucgggacccuggcccucagccugaccuucauccgcuccaccaugagccuggugauggccuggcggacgaucauggccgugcucuucgucgugacccugaucccccugugccgcaccuccugccuccagaagcagagccacuggguggagaucaccgcgcugauccugggcgcccaggcccuccccgucuaccugaugacgcugaugaagggggccucccggcgcagcuggccccucaacgagggcaucauggcgguggggcuggugucccugcucggcagcgcccugcugaagaacgacgucccgcucgccggccccaugguggccgggggccugcugcucgccgcguacgugauguccgggagcagcgccgaccugucccuggagaaggccgccaacguccagugggacgagauggccgacaucaccggcagcucccccaucaucgaggugaagcaggacgaggacgggagcuucuccauccgggacguggaggagaccaacaugaucacccuccuggucaagcuggcgcucaucacggugagcggccuguacccccuggccaucccggugaccaugacccucugguacauguggcaggucaagacccagcgcuccggcgcccugugggacgugcccagccccgccgccacccagaaggcggcccuguccgaggggguguaccggaucaugcagcgcggccucuucgggaagacgcaggucggcguggggauccacauggagggcguguuccacaccauguggcacgucacccggggcagcgugaucugccacgagaccgggcgccuggagcccuccugggccgacgugcgcaacgacaugaucagcuacggcgggggcuggcggcugggcgacaagugggacaaggaggaggacguccaggugcucgccaucgagccggggaagaaccccaagcacgugcagacgaagcccggccuguucaagacccugaccggggagaucggcgccgucacccucgacuucaagcccgggacguccggcagcccgaucaucaaccgcaagggcaaggugaucgggcuguacggcaacgggguggucaccaaguccggcgacuacgugagcgcgaucacccaggccgagcggaucggggagcccgacuacgagguggacgaggacaucuuccgcaagaagcggcugaccaucauggaccuccaccccggcgccggcaagacgaagcgcauccugccguccaucguccgggaggcccugaagcgccggcugcgcacccucauccuggcgcccacccgggugguggccgccgagauggaggaggcccugcgcgggcuccccauccgguaccagacccccgccgucaagagcgagcacacgggccgcgagaucguggaccugaugugccacgcgaccuucaccacccggcugcucuccagcacgcgcgugccgaacuacaaccugaucgucauggacgaggcccacuucaccgaccccagcuccguggccgcccggggguacaucagcacccgcgucgagaugggcgaggccgcggccaucuucaugaccgccacgccccccggggccaccgacccguucccccaguccaacagccccaucgaggacaucgagcgggagauccccgagcgcuccuggaacaccggcuucgacuggaucaccgacuaccagggcaagacggugugguucgugccgagcaucaaggccgggaacgacaucgcgaacugccugcgcaaguccggcaagaaggucauccagcucagccggaagaccuucgacaccgaguaccccaagaccaagcugacggacugggacuucguggugaccaccgacaucuccgagaugggggccaacuuccgcgccggccgggucaucgacccccgccggugccugaagcccgugauccucaccgacgggccggagcgcgugauccuggccggccccauccccgucacgcccgcgagcgccgcccagcggcgcggccggaucgggcgcaacccggcccaggaggacgaccaguacguguucuccggcgacccccugaagaacgacgaggaccacgcccacuggaccgaggcgaagaugcuccuggacaacaucuacacccccgaggggaucauccccacccuguucggcccggagcgggagaagacgcaggccaucgacggcgaguuccgccuccggggggagcagcgcaagaccuucguggagcugaugcggcgcggcgaccugcccgucuggcucagcuacaagguggccuccgccgggaucagcuacaaggaccgggaguggugcuucaccggcgagcgcaacaaccagauccuggaggagaacauggagguggagaucuggacccgggagggggagaagaagaagcugcgccccaaguggcucgacgcccgggucuacgcggaccccauggcccugaaggacuucaaggaguucgccuccggccgcaagagcaucacccuggacauccucacggagaucgccucccugccgaccuaccugagcucccgcgccaagcucgcgcuggacaacaucgugaugcugcacaccaccgagcggggcgggcgcgccuaccagcacgcccucaacgagcugcccgagagccuggagacgcucaugcugguggcccugcucggcgcgaugaccgccgggaucuuccuguucuucaugcagggcaaggggaucggcaagcugagcaugggccucaucaccaucgccgucgccuccgggcugcuguggguggccgagauccagccccaguggaucgcggccagcaucauccucgaguucuuccugauggugcugcucaucccggagcccgagaagcagcggaccccccaggacaaccagcugaucuacgucauccugacgauccucaccaucaucggccugaucgccgccaacgagauggggcugaucgagaagaccaagaccgacuucggcuucuaccaggugaagacggagaccaccauccucgacguggaccugcgccccgccuccgcguggacccuguacgccgucgccacgaccauccucaccccgaugcugcggcacaccaucgagaacacgagcgccaaccugucccucgccgcgaucgccaaccaggccgccgugcugauggggcugggcaagggcuggccccuccaccgcauggaccugggggugccccugcucgccaugggcugcuacagccaggucaaccccaccacccugaccgcgucccuggugaugcuccuggugcacuacgccaucaucgggccgggccugcaggccaaggccacgcgggaggcgcagaagcgcaccgccgccggcaucaugaagaaccccaccgucgacgggaucaccgugaucgaccucgagcccaucagcuacgaccccaaguucgagaagcagcugggccaggugaugcugcucguccugugcgccgggcagcugcuccugaugcggacgaccugggccuucugcgaggugcugacccucgcgaccggcccgauccugacgcugugggaggggaaccccggccgcuucuggaacaccaccaucgccguguccaccgccaacaucuuccggggcagcuaccucgccggggccggccuggcguucucccugaucaagaacgcccagacgccccgccgggggaccggcaccaccggggagacccucggcgagaaguggaagcgccagcugaacagccuggaccggaaggaguucgaggaguacaagcgcuccggcauccucgaggucgaccggacggaggccaagagcgcccugaaggacggguccaagaucaagcacgccgugagccgcggcuccagcaagauccgguggaucguggagcgcgggauggucaagcccaagggcaaggugguggaccuggggugcggccgcggcgggugguccuacuacauggcgacccucaagaacgucaccgaggugaagggcuacaccaaggggggcccggggcacgaggagcccauccccauggccacguacggcuggaaccuggugaagcugcacagcggcgucgacguguucuacaagcccaccgagcagguggacacccuccugugcgacaucggggagagcuccagcaacccgaccaucgaggagggccggacgcugcgcguccucaagaugguggagcccuggcuguccagcaagcccgaguucugcaucaaggugcugaaccccuacaugccgaccgucaucgaggagcuggagaagcuccagcggaagcacgggggcaaccuggugcgcugcccccugucccggaacagcacccacgagauguacugggucuccggcgccagcgggaacaucguguccagcgugaacaccacguccaagaugcuccugaaccgcuucaccacccggcaccgcaagcccaccuacgagaaggacgucgaccugggcgccgggacgcggagcguguccaccgagaccgagaagcccgacaugaccaucaucggccgccggcuccagcgccugcaggaggagcacaaggagacguggcacuacgaccaggagaacccguaccggaccugggcguaccacgggagcuacgaggcccccuccaccggcagcgccuccagcauggugaacggcgucgugaagcugcucaccaagcccugggacgugaucccgauggucacgcagcuggccaugaccgacaccacccccuucgggcagcagcgcguguucaaggagaagguggacacgcggaccccccagcccaagccgggcacccgcauggucaugaccacgaccgccaacuggcugugggcgcuccuggggaagaagaagaacccccggcugugcacccgcgaggaguucaucuccaaggugcggagcaacgccgccaucggcgccguguuccaggaggagcagggguggaccagcgccuccgaggcggucaacgacagccgcuucugggagcucguggacaaggagcgggcccugcaccaggagggcaagugcgaguccugcguguacaacaugaugggcaagcgcgagaagaagcugggggaguucggccgcgccaaggggagccgggccaucugguacauguggcucggcgcccgcuuccuggaguucgaggcgcugggguuccucaacgaggaccacugguucggccgggagaacuccuggagcggcgucgagggggagggccugcaccgccugggguacauccucgaggagaucgacaagaaggacggcgaccugauguacgccgacgacacggccggcugggacacccggaucaccgaggacgaccugcagaacgaggagcucaucaccgagcagauggccccccaccacaagauccuggcgaaggccaucuucaagcugaccuaccagaacaagguggugaagguccuccgccccacgccgcggggggccgugauggacaucaucucccgcaaggaccagcggggcagcgggcaggugggcaccuacgggcugaacaccuucaccaacauggagguccagcugauccgccagauggaggccgagggcgugaucacgcaggacgacaugcagaaccccaagggccucaaggagcggguggagaaguggcugcgcgagugcggggucgaccggcugaagcgcauggccaucuccggcgacgacugcguggugaagccccucgacgagcgguucgggaccagccugcuguuccucaacgacaugggcaagguccgcaaggacaucccccagugggagccguccaagggguggaagaacuggcaggaggugcccuucugcagccaccacuuccacaagaucuucaugaaggacggccggucccuggugguccccugccgcaaccaggacgagcugaucggccgggcgcgcaucagccagggggccggcuggucccuccgcgagaccgccugccuggggaaggccuacgcccagauguggagccugauguacuuccaccggcgcgaccuccggcuggcguccauggccaucugcagcgccgugcccaccgagugguucccgacgagccgcaccaccugguccauccacgcccaccaccaguggaugaccacggaggacaugcugaagguguggaaccgggucuggaucgaggacaaccccaacaugaucgacaagacccccgugcacagcugggaggacauccccuaccucggcaagcgcgaggaccuguggugcgggucccugaucggccucagcucccgggccaccugggcgaagaacauccacaccgccaucacgcaggugcgcaaccugaucggcaaggaggaguacgucgacuacaugccggugaugaagcgguacagcgcccccuccgagagcgagggggugcuguga

SEQ ID NO: 10467 - RNA, 9867 nt, Artificial Sequence
  derived and/or modified CDS sequence (opt1) from DENV-4__FJ639748__SS-prME
agcaccaugacccugcucugccugauccccaccgccauggccuuccaccuguccacccgcgacggcgagccccucaugaucguggccaagcacgagcgggggcgcccccugcuguucaagaccaccgagggcaucaacaagugcacccucaucgccauggaccugggggagaugugcgaggacaccgugaccuacaagugcccccugcucgugaacaccgagcccgaggacaucgacugcuggugcaaccugaccagcaccugggugauguacgggaccugcacccaguccggggagcggcgccgggagaagcgcagcguggcccugaccccgcacuccggcaugggccucgagacccgggccgagaccuggaugagcuccgagggggccuggaagcacgcgcagcgcguggagagcuggauccugcggaaccccggcuucgcccugcucgccggguucauggccuacaugaucggccagaccgggauccagcgcacgguguucuucguccugaugaugcugguggcgcccuccuacggcaugcggugcgugggcgucgggaaccgcgacuucguggagggcgugagcgggggcgccugggucgaccucgugcuggagcacggcgggugcgugaccaccauggcccagggcaagcccacccuggacuucgagcucacgaagaccaccgccaaggaggucgcccugcugcggaccuacugcaucgaggcgcucaucuccaacaucacgaccgccacccgcugcccgacccagggggagcccuaccugaaggaggagcaggaccagcaguacaucugccggcgcgacgugguggaccggggcugggggaacggcugcggccuguucgggaagggcggggucgugacgugcgccaaguucagcugcuccggcaagaucaccgggaaccucgugcagaucgagaaccuggaguacaccgucguggugaccguccacaacggcgacacgcacgccgugggcaacgacaccagcaaccacggggucaccgccaccaucacgccccgcucccccagcguggaggugcagcugccggacuacggcgagcucacccuggacugcgagccccgguccgggaucgacuucaacgagaugauccugaugaagaugaagaagaagaccuggcucguccacaagcagugguuccuggaccugccccuccccuggaccgcgggcgccgacaccagcgaggugcacuggaacuacaaggagcgcauggugacguucaaggucccgcacgccaagcggcaggacgugaccgugcuggggucccaggagggcgccaugcacagcgcccuggcgggcgccaccgaggucgacagcggggacggcaaccacauguucgccgggcaccucaagugcaaggugcgcauggagaagcugcgcaucaagggcauguccuacaccaugugcagcggcaaguucuccaucgacaaggagauggccgagacgcagcacgggaccaccguggucaaggugaaguacgagggcgccggggcgcccugcaaggugcccaucgagauccgggacgucaacaaggagaagguggugggccgcgucaucagcuccacgccccuggccgagaacacgaacagcgugaccaacaucgagcucgagccgcccuucggggacuccuacaucgugaucggcgucggcaacagcgcccugacccugcacugguuccggaagggguccagcaucggcaagauguucgaguccaccuaccgcggggccaagcggauggcgauccucggcgagacggccugggacuucgggagcgugggcggccuguucaccucccuggggaaggccgugcaccaggucuucggcagcguguacaccaccauguucgggggcguguccuggaugauccgcauccucaucgggcugcugguccuguggaucggcacgaacagccggaacaccuccauggccaugaccugcaucgccgugggcgggaucacccucuuccugggcuucacggugcaggcggacgucgggugcguggugagcugguccggccgcgagcugaagugcgggagcggcaucuucgucguggacaacgugcacaccuggaccgagcaguacaaguuccagcccgagagccccgcccggcucgccuccgccauccugaacgcccacaaggacggcgucugcgggauccgcagcaccacgcggcuggagaacgugauguggaagcagaucaccaacgagcucaacuacgugcugugggagggcgggcacgaccugaccgucguggcgggcgacgugaagggcguccucaccaaggggaagcgcgcccugacgccgcccguguccgaccugaaguacagcuggaagaccuggggcaaggccaagaucuucacccccgaggcccggaacuccaccuuccucaucgacgggcccgacacgagcgagugcccgaacgagcgccgggccuggaacucccuggagguggaggacuacggcuucgggauguucaccaccaacaucuggaugaaguuccgcgagggcagcuccgaggucugcgaccaccggcugaugagcgcggccaucaaggaccagaaggccgugcacgccgacaugggcuacuggaucgaguccagcaagaaccagaccuggcagaucgagcgcgcgucccucaucgaggugaagacgugccuguggcccaagacccacacccuguggagcaacgggguccucgagucccagaugcugauccccaagagcuacgccggcccguucucccagcacaacuaccggcagggguacgccacccagaccgugggccccuggcaccuggggaagcucgagaucgacuucggcgagugccccggcacgaccgugaccauccaggaggacugcgaccaccgcgggcccagccugcgcaccacgaccgccagcggcaagcuggucacccaguggugcugccgguccugcaccaugccgccccuccgcuuccugggggaggacggcugcugguacgggauggagauccggccccugagcgagaaggaggagaacauggugaagucccaggucacggccggccagggcaccagcgagaccuucuccauggggcuccugugccugacccucuucguggaggagugccugcgccggcgcgugacgcggaagcacaugauccuggcggucgugaucacccucugcgccaucauccugggcgggcugaccuggauggaccuccugcgcgcccugaucaugcucggcgacaccaugagcggccggaucgggggccagacgcaccuggccaucauggccguguucaagaugucccccggguacguccugggcguguuccuccgcaagcugaccagccgggagaccgcgcugauggugaucgggauggccaugaccacgacccucuccaucccgcacgaccugauggagcugaucgacggcaucagccucggccugauccugcucaagaucgucacccaguucgacaacacccagguggggacgcuggcccugucccucaccuucauccgcagcaccaugucccuggugauggccuggcggaccaucauggccguccuguucguggugacgcucaucccccugugccgcaccagcugccugcagaagcagucccacugggucgagaucaccgcgcucauccugggcgcccaggcccugcccguguaccucaugacccugaugaagggggccagccggcgcuccuggccccugaacgagggcaucauggcgguggggcucgucagccugcugggcuccgcccuccugaagaacgacgugccgcuggccggccccaugguggccgggggccuccugcuggccgcguacgucaugagcgggagcuccgccgaccucagccuggagaaggccgccaacgugcagugggacgagauggccgacaucacgggcuccagccccaucaucgaggugaagcaggacgaggacggguccuucagcauccgggacgucgaggagaccaacaugaucacccugcucgugaagcuggcgcugaucaccguguccggccucuacccccuggccaucccggucacgaugacccugugguacauguggcaggucaagacccagcgcagcggcgcccucugggacgugcccucccccgccgccacccagaaggcggcccugagcgagggggucuaccggaucaugcagcgcggccuguucgggaagacccaggugggcguggggauccacauggagggcgucuuccacacgauguggcacgugacccggggcuccgugaucugccacgagaccgggcgccucgagcccagcugggccgacguccgcaacgacaugaucuccuacggcgggggcuggcggcugggcgacaagugggacaaggaggaggacguccaggugcuggccaucgagccggggaagaaccccaagcacguccagaccaagcccggccucuucaagacgcugaccggggagaucggcgccgugacccuggacuucaagcccgggaccagcggcuccccgaucaucaaccgcaagggcaaggugaucgggcucuacggcaacggggucgugaccaagagcggcgacuacguguccgcgaucacccaggccgagcggaucggggagcccgacuacgaggucgacgaggacaucuuccgcaagaagcggcugaccaucauggaccugcaccccggcgccggcaagaccaagcgcauccugccgagcaucgugcgggaggcccucaagcgccggcugcgcacgcugauccucgcgcccacccggguggucgccgccgagauggaggaggcccugcgcgggcugcccauccgguaccagacccccgccgugaaguccgagcacaccggccgcgagaucguggaccucaugugccacgcgacguucaccacccggcugcugagcagcacccgcgucccgaacuacaaccucaucgugauggacgaggcccacuucacggaccccuccagcgucgccgcccggggguacaucuccacccgcguggagaugggcgaggccgcggccaucuucaugaccgccacgccgcccggggccacggacccguucccccagagcaacucccccaucgaggacaucgagcgggagauccccgagcgcagcuggaacaccggcuucgacuggaucaccgacuaccagggcaagaccgugugguucgucccguccaucaaggccgggaacgacaucgcgaacugccugcgcaagagcggcaagaaggugauccagcugucccggaagacguucgacaccgaguaccccaagaccaagcucaccgacugggacuucguggucacgaccgacaucagcgagaugggggccaacuuccgcgccggccgggugaucgacccccgccggugccugaagcccgugauccugaccgacgggccggagcgcgucauccucgccggccccauccccgugacccccgcguccgccgcccagcggcgcggccggaucgggcgcaacccggcccaggaggacgaccaguacguguucagcggcgacccccugaagaacgacgaggaccacgcccacuggacggaggcgaagaugcugcucgacaacaucuacacccccgaggggaucauccccacccuguucggcccggagcgggagaagacccaggccaucgacggcgaguuccgccugcgcggggagcagcgcaagacguucgucgagcucaugcggcgcggcgaccugcccguguggcuguccuacaagguggccagcgccgggaucuccuacaaggaccgggaguggugcuucaccggcgagcgcaacaaccagauccucgaggagaacauggaggucgagaucuggacccgggagggggagaagaagaagcugcgcccccgguggcuggacgcccgcguguacgcggaccccauggcccucaaggacuucaaggaguucgccagcggccgcaaguccaucacccuggacauccugaccgagaucgccagccucccgacguaccuguccagccgggccaagcuggcgcucgacaacaucgugaugcugcacaccaccgagcgcggcgggcgggccuaccagcacgcccugaacgagcuccccgagagccuggagacccugaugcucgucgcccugcugggcgcgaugacggccgggaucuuccucuucuucaugcagggcaaggggaucggcaagcuguccaugggccugaucaccaucgccguggccagcgggcuccuguggguggccgagauccagccccaguggaucgcggccuccaucauccuggaguucuuccucaugguccugcugaucccggagcccgagaagcagcgcacgccccaggacaaccagcucaucuacgugauccugaccauccugacgaucaucggccucaucgccgccaacgagauggggcugaucgagaagaccaagaccgacuucggcuucuaccaggugaagaccgagacgaccauccuggacgucgaccuccggcccgccagcgcguggacccuguacgccguggccaccacgauccugaccccgaugcuccgccacaccaucgagaacaccuccgccaaccugagccuggccgcgaucgccaaccaggccgccgugcucauggggcugggcaagggcuggccccugcaccggauggaccucggggucccccugcuggccaugggcugcuacucccaggugaaccccacgacccucaccgcgagccuggugaugcugcucguccacuacgccaucaucgggccgggccugcaggccaaggccacccgcgaggcgcagaagcggacggccgccggcaucaugaagaaccccaccguggacgggaucaccgugaucgaccuggagcccaucuccuacgaccccaaguucgagaagcagcucggccaggucaugcugcuggugcucugcgccgggcagcugcugcucaugcgcaccacgugggccuucugcgaggugcugacccuggcgaccggcccgauccucacccugugggaggggaaccccggccgguucuggaacacgaccaucgccgucagcaccgccaacaucuuccgcggcuccuaccuggccggggccggccucgcguucagccugaucaagaacgcccagacgccccggcgcgggacgggcaccaccggggagacccugggcgagaaguggaagcggcagcucaacucccuggaccgcaaggaguucgaggaguacaagcggagcggcauccuggagguggaccgcaccgaggccaaguccgcccucaaggacgggagcaagaucaagcacgccgugucccggggcagcuccaagauccgcuggaucgucgagcgcgggauggugaagcccaagggcaagguggucgaccuggggugcggccggggcggguggagcuacuacauggcgacgcugaagaacgugaccgaggugaagggcuacaccaagggcggcccggggcacgaggagcccauccccauggccaccuacggcuggaaccucgucaagcugcacagcggcguggacguguucuacaagcccacggagcaggucgacacccugcucugcgacaucggggaguccagcuccaacccgaccaucgaggagggccgcacccugcgggugcugaagaugguggagcccuggcugagcuccaagcccgaguucugcaucaagguccucaaccccuacaugccgacggugaucgaggagcuggagaagcugcagcgcaagcacgggggcaaccucguccggugcccccugagccgcaacuccacccacgagauguacugggugagcggcgccuccgggaacaucgugagcuccgucaacaccaccagcaagaugcugcucaaccgguucacgacccgccaccggaagcccaccuacgagaaggacguggaccugggcgccgggacccgcuccgugagcacggagaccgagaagcccgacaugaccaucaucggccggcgccugcagcggcuccaggaggagcacaaggagaccuggcacuacgaccaggagaacccguaccgcacgugggcguaccacggguccuacgaggcccccagcaccggcuccgccagcuccauggucaacggcguggugaagcugcugaccaagcccugggacgucaucccgauggugacccagcucgccaugacggacaccacccccuucgggcagcagcggguguucaaggagaaggucgacacccgcacgccccagagcaagcccggcacccggauggugaugaccaccacggccaacuggcugugggcgcugcucgggaagaagaagaacccgcgccugugcacccgggaggaguucaucagcaaggugcgcuccaacgccgccaucggcgccgucuuccaggaggagcagggguggaccagcgccuccgaggcggugaacgacagccgguucugggagcugguggacaaggagcgcgcccuccaccaggagggcaagugcgaguccugcgucuacaacaugaugggcaagcgcgagaagaagcugggggaguucggccgggccaaggggagccgcgccaucugguacauguggcugggcgcccgguuccucgaguucgaggcgcugggguuccugaacgaggaccacugguucggccgcgagaacuccuggagcggcguggagggggagggccuccaccggcugggguacauccuggaggagaucgacaagaaggacggcgaccucauguacgccgacgacaccgccggcugggacacgcgcaucaccgaggacgaccugcagaacgaggagcugaucaccgagcagauggcgccccaccacaagauccucgcgaaggccaucuucaagcugaccuaccagaacaagguggucaaggugcugcggcccacgccccgcggggccgugauggacaucaucucccggaaggaccagcggggcagcgggcaggucggcacguacgggcucaacaccuucaccaacauggaggugcagcugauccggcagauggaggccgagggcgugaucacccaggacgacaugcagaacccgaagggccugaaggagcgcgucgagaaguggcuccgggagugcgggguggaccgccugaagcggauggccaucuccggcgacgacugcguggucaagccccuggacgagcgcuucgcgacgagccuccuguuccugaacgacauggggaaggugcggaaggacaucccccagugggagcccuccaagggcuggaagaacuggcaggaggugccguucugcagccaccacuuccacaagaucuucaugaaggacgggcgcucccucgucgugcccugccggaaccaggacgagcugaucggccgcgcccgcaucagccagggcgccggguggucccugcgggagaccgccugccucggcaaggccuacgcgcagauguggagccugauguacuuccaccgccgggaccugcgccucgccagcauggccaucugcuccgccgugcccaccgagugguuccccaccagccggacgaccugguccauccacgcccaccaccaguggaugaccaccgaggacaugcugaaggucuggaaccgcguguggaucgaggacaacccgaacaugaucgacaagacgcccgugcacagcugggaggacauccccuaccuggggaagcgggaggaccucuggugcggcucccugaucgggcugagcucccgcgcgaccugggccaagaacauccacaccgccaucacccagguccggaaccucaucggcaaggaggaguacguggacuacaugcccgugaugaagcgcuacagcgccccguccgagaacgagggcguccuguga

SEQ ID NO: 10468 - RNA, 9867 nt, Artificial Sequence
  derived and/or modified CDS sequence (opt1) from DENV-4__FJ639764__SS-prME
agcaccaucacccugcucugccugauccccacggugauggccuuccaccuguccacccgcgacggcgagccccucaugaucguggccaagcacgagcgggggcgcccccugcuguucaagaccaccgagggcacgaacaagugcacccucaucgcgauggaccugggggagaugugcgaggacaccgugaccuacaagugcccccugcucgugaacacggagcccgaggacaucgacugcuggugcaaccugaccagcaccugggugauguacgggaccugcacgcaguccggggagcggcgccgggagaagcgcagcguggcccugaccccgcacuccggcaugggccucgagacccgggccgagaccuggaugagcuccgagggggccuggaagcacgcccagcgcguggagagcuggauccugcggaaccccggcuucgcgcugcucgccggguucauggccuacaugaucggccagacggggauccagcgcaccguguucuucgugcugaugaugcugguggcccccuccuacggcaugcggugcgucggcguggggaaccgcgacuucguggagggcgucagcgggggcgcguggguggaccucgugcuggagcacggcgggugcgucaccaccauggcccagggcaagcccacgcuggacuucgagcucaccaagaccaccgccaaggagguggcccugcugcggacguacugcaucgaggcccucaucuccaacaucaccaccgcgacccgcugcccgacgcagggggagcccuaccugaaggaggagcaggaccagcaguacaucugccggcgcgacguggucgaccggggcugggggaacggcugcggccuguucgggaagggcgggguggugaccugcgccaaguucagcugcuccggcaagaucaccgggaaccucguccagaucgagaaccuggaguacaccgugguggucacggugcacaacggcgacacccacgccgucggcaacgacaccagcaaccacggggugaccgccacgaucacgccccggucccccagcguggaggucaagcugccggacuacggcgagcucacccuggacugcgagccccgguccgggaucgacuucaacgagaugauccugaugaagaugaagaagaagaccuggcucgugcacaagcagugguuccuggaccugccccuccccuggaccgccggcgcggacacgagcgaggugcacuggaacuacaaggagcgcauggucaccuucaaggugccgcacgccaagcggcaggacgugaccguccuggggucccaggagggcgccaugcacagcgcccuggccggcgcgaccgagguggacagcggggacggcaaccacauguucgccgggcaccucaagugcaaggugcgcauggagaagcugcgcaucaagggcauguccuacacgaugugcagcggcaaguucuccaucgacaaggagauggccgagacccagcacgggaccaccgucgugaaggugaaguacgagggcgccggggcccccugcaagguccccaucgagauccgggacgugaacaaggagaagguggucggccgcgugaucagcuccacgccccuggcggagaacaccaacagcgugaccaacaucgagcucgagccgcccuucggggacuccuacaucgucaucggcgugggcaacagcgcccugacccugcacugguuccggaagggguccagcaucggcaagauguucgaguccacguaccgcggggccaagcggauggccauccucggcgagaccgcgugggacuucgggagcgugggcggccuguucaccucccuggggaaggccguccaccagguguucggcagcguguacaccacgauguucgggggcgucuccuggaugauccgcauccucaucggguuccuggugcuguggaucggcaccaacagccggaacaccuccauggccaugaccugcaucgccgugggcgggaucacgcuguuccucggcuucaccguccaggccgacauggggugcguggugagcugguccggccgcgagcugaagugcgggagcggcaucuucgucguggacaacgugcacaccuggaucgagcaguacaaguuccagcccgagagccccgcgcggcuggccuccgccauccucaacgcccacaaggacggcgucugcgggauccgcagcaccacgcggcuggagaacgugauguggaagcagaucaccaacgagcugaacuacgugcucugggagggcgggcacgaccugaccgucguggccggcgacgugaagggcguccugaccaaggggaagcgcacgcucaccccgcccguguccgaccugaaguacagcuggaagaccuggggcaaggcgaagaucuucacccccgaggcccggaacuccacguuccugaucgacgggcccgacaccagcgagugcccgaacgagcgccgggccuggaacucccucgagguggaggacuacggcuucgggauguucaccaccaacaucuggaugaaguuccgcgagggcagcuccgaggucugcgaccaccggcugaugagcgccgccaucaaggaccagaaggcggugcacgccgacaugggcuacuggaucgaguccagcaagaaccagacguggcagaucgagcgcgccucccugaucgaggugaagaccugccucuggcccaagacccacacccuguggagcaacgggguccuggagucccagaugcucauccccaagagcuacgccggcccguucucccagcacaacuaccggcagggguacgcgacccagacggugggccccuggcaccuggggaagcuggagaucgacuucggcgagugccccggcaccaccgugaccauccaggaggacugcgaccaccgcgggcccagccuccgcacgaccaccgccagcggcaagcuggucacccaguggugcugccgguccugcacgaugccgccccugcgcuuccucggggaggacggcugcugguacgggauggagauccggccccugagcgagaaggaggagaacauggugaagucccaggucaccgccggccagggcaccagcgagaccuucuccauggggcugcucugccugacgcuguucguggaggagugccuccgccggcgcgugacccggaagcacaugauccuggccgucgugaucacccugugcgccaucauccucggcgggcugaccuggauggaccugcuccgcgcgcugaucaugcugggcgacacgaugagcggccggaucgggggccagacccaccucgccaucauggccguguucaagaugucccccggguacguccugggcguguuccugcgccggcucaccagccgcgagaccgcccugauggugaucgggauggccaugacgaccacccuguccaucccgcacgaccucauggagcugaucgacggcaucagccugggccucauccugcugaagaucgucacccaguucgacaacacccagguggggacccucgcgcugucccugaccuucauccggagcaccaugucccucgugauggccuggcgcacgaucauggccguccuguucguggugacccugaucccccucugccggaccagcugccugcagaagcagucccacugggucgagaucaccgcccugauccucggcgcccaggcgcugcccguguaccugaugacgcucaugaagggggccagccgccgguccuggccccugaacgagggcaucauggccguggggcuggucagccuccugggcuccgcccugcucaagaacgacgugccgcuggcgggccccaugguggccgggggccugcuccuggccgccuacgucaugagcgggagcuccgccgaccugagccucgagaaggcggccaacgugcagugggacgagauggccgacaucaccggcuccagccccaucaucgaggugaagcaggacgaggacggguccuucagcauccgcgacgucgaggagaccaacaugaucacccugcuggugaagcucgcccugaucacgguguccggccuguacccccucgccaucccggucaccaugacccugugguacauguggcaggucaagacccagcggagcggcgcgcugugggacgugcccucccccgccgccacccagaaggccgcccucagcgagggggucuaccgcaucaugcagcggggccuguucgggaagacccaggugggcguggggauccacauggagggcgucuuccacaccauguggcacgugacccgcggcuccgugaucugccacgagaccgggcgccuggagcccagcugggcggacguccggaacgacaugaucuccuacggcgggggcuggcgccucggcgacaagugggacaaggaggaggacguccaggugcuggccgucgagccggggaagaaccccaagcacgugcagacgaagcccggccuguucaagaccaucaccggggagaucggcgccgugacccucgacuucaagcccgggacgagcggcuccccgaucaucaaccggaagggcaaggucaucgggcuguacggcaacgggguggugaccaagagcggcgacuacgucuccgccaucacccaggccgagcgcaucggggagcccgacuacgagguggacgaggacaucuuccggaagaagcgccugaccaucauggaccuccaccccggcgcgggcaagacgaagcggauccugccgagcaucgugcgcgaggcccugaagcggcgccugcggacccucauccuggcccccacccgcgucguggccgcggagauggaggaggcccugcgggggcuccccauccgcuaccagacccccgccgugaaguccgagcacacgggccgggagaucgucgaccugaugugccacgccaccuucaccacccgccugcucagcagcacgcgggugccgaacuacaaccugaucgucauggacgaggcccacuucaccgaccccuccagcguggcggcccgcggguacaucuccacccggguggagaugggcgaggccgccgccaucuucaugaccgcgacgccgcccggggccaccgacccguucccccagagcaacucccccaucgaggacaucgagcgcgagauccccgagcgcagcuggaacaccggcuucgacuggaucaccgacuaccagggcaagacggucugguucgugccguccaucaaggccgggaacgacaucgccaacugccugcgcaagagcggcaagaaggugauccagcucucccgcaagaccuucgacaccgaguaccccaagaccaagcugacggacugggacuucgucgugaccaccgacaucagcgagaugggggccaacuuccgggcgggccgcgugaucgacccccggcgcugccugaagcccgucauccucaccgacgggccggagcgggugauccuggccggccccauccccgugacgcccgccuccgccgcgcagcgccggggccgcaucgggcggaacccggcccaggaggacgaccaguacgucuucagcggcgacccccugaagaacgacgaggaccacgcccacuggaccgaggccaagaugcuccuggacaacaucuacacccccgaggggaucauccccacccuguucggcccggagcgcgagaagacgcaggccaucgacggcgaguuccggcuccgcggggagcagcggaagaccuucguggagcugaugcgccggggcgaccugcccguguggcucuccuacaaggucgcgagcgccgggaucuccuacaaggaccgcgaguggugcuucaccggcgagcggaacaaccagauccuggaggagaacauggagguggagaucuggacccgcgagggggagaagaagaagcugcggccccgcuggcucgacgcccgcguguacgccgaccccauggcccugaaggacuucaaggaguucgcgagcggccggaaguccaucacccuggacauccucacggagaucgccagccugccgaccuaccuguccagccgcgccaagcucgcccuggacaacaucgucaugcugcacaccaccgagcggggcgggcgcgccuaccagcacgcgcucaacgagcugcccgagagccuggagacgcucaugcugguggcccugcucggcgccaugaccgccgggaucuuccuguucuucaugcagggcaaggggaucggcaagcuguccaugggccucaucaccaucgcgguggccagcgggcugcugugggucgccgagauccagccccaguggaucgccgccuccaucauccucgaguucuuccugauggugcugcucaucccggagcccgagaagcagcggacgccccaggacaaccagcugaucuacgugauccugacgauccucaccaucaucggccugaucgcggccaacgagauggggcugaucgagaagaccaagaccgacuucggcuucuaccaggucaagacggagaccaccauccucgacguggaccugcgccccgccagcgccuggacccuguacgccguggcgacgaccauccucaccccgaugcugcggcacaccaucgagaacacguccgccaaccugagccucgccgccaucgccaaccaggcggccguccugauggggcugggcaagggcuggccccuccaccgcauggaccugggggugccccugcucgccaugggcugcuacucccaggugaaccccaccacccugaccgccagccuggucaugcuccuggugcacuacgccaucaucgggccgggccugcaggcgaaggccacgcgggaggcccagaagcgcaccgccgcgggcaucaugaagaaccccaccguggacgggaucaccgucaucgaccucgagcccaucuccuacgaccccaaguucgagaagcagcugggccaggugaugcugcucgugcugugcgccgggcagcugcuccugaugcggacgaccugggccuucugcgagguccugacccucgccaccggcccgauccugacgcugugggaggggaaccccggccgcuucuggaacaccaccaucgccgugagcaccgcgaacaucuuccggggcuccuaccucgccggggccggccuggccuucagccugaucaagaacgcccagacgccccgccgggggaccggcaccaccggggagacccucggcgagaaguggaagcgccagcugaacucccuggaccggaaggaguucgaggaguacaagcgcagcggcauccucgagguggaccggacggaggcgaaguccgcccugaaggacgggagcaagaucaagcacgccgucucccgcggcagcuccaagauccgcuggaucguggagcgggggauggugaagcccaagggcaaggucguggaccuggggugcggccgcggcggguggagcuacuacauggccacccucaagaacgugaccgaggucaagggcuacaccaagggcgggccggggcacgaggagcccauccccauggccacguacggcuggaaccuggugaagcugcacagcggcguggacgucuucuacaagcccaccgagcaggucgacacccuccugugcgacaucggggaguccagcuccaacccgaccaucgaggagggccggacgcugcgcgugcucaagauggucgagcccuggcugagcuccaagcccgaguucugcaucaaggugcugaaccccuacaugccgaccgucaucgaggagcuggagaagcuccagcggaagcacgggggcaaccuggugcgcugcccccugagccggaacuccacccacgagauguacugggugagcggcgcguccgggaacaucgucagcuccgugaacaccacgagcaagaugcuccugaaccgcuucaccacccggcaccgcaagcccaccuacgagaaggacguggaccugggcgccgggacgcgguccgucagcaccgagaccgagaagcccgacaugaccaucaucggccgccggcuccagcgccugcaggaggagcacaaggagacguggcacuacgaccaggagaacccguaccggaccugggccuaccacggguccuacgaggcccccagcaccggcuccgcgagcuccauggugaacggcguggucaagcugcucaccaagcccugggacgugaucccgauggugacgcagcuggccaugaccgacaccacccccuucgggcagcagcgcgucuucaaggagaagguggacacgcggacgccccagcccaagccgggcacccgcauggugaugaccacgaccgccaacuggcugugggcccuccuggggaagaagaagaacccccggcugugcacccgcgaggaguucaucagcaagguccggagcaacgccgcgaucggcgccguguuccaggaggagcagggguggaccuccgccagcgaggccgugaacgacucccgcuucugggagcucgucgacaaggagcgcgcccugcaccaggagggcaagugcgagagcugcguguacaacaugaugggcaagcgggagaagaagcugggggaguucggccgcgcgaaggggucccgggccaucugguacauguggcucggcgcccgcuuccuggaguucgaggcccugggguuccucaacgaggaccacugguucggccgggagaacagcugguccggcguggagggggagggccugcaccgccugggguacauccucgaggagaucgacaagaaggacggcgaccugauguacgccgacgacacggcgggcugggacacccggaucaccgaggacgaccugcagaacgaggagcucaucaccgagcagauggcgccccaccacaagauccuggccaaggccaucuucaagcugaccuaccagaacaaggucgugaaggugcuccgccccacgccgcgcggggccgucauggacaucaucagccggaaggaccagcggggcuccggccaggugggcaccuacgggcugaacaccuucaccaacauggaggugcagcugauccgccagauggaggccgagggcgucaucacgcaggacgacaugcagaaccccaagggccucaaggagcggguggagaaguggcugcgcgagugcgggguggaccggcugaagcgcauggccaucagcggcgacgacugcgucgugaagccccucgacgagcgguucgggaccucccugcuguuccucaacgacaugggcaaggugcgcaaggacaucccccagugggagccgagcaagggguggaagaacuggcaggagguccccuucugcucccaccacuuccacaagaucuucaugaaggacggccggagccugguggugcccugccgcaaccaggacgagcugaucggccgcgcccggaucucccagggggccggcuggagccuccgcgagaccgcgugccuggggaaggccuacgcccagauguggucccugauguacuuccaccggcgcgaccuccggcuggccagcauggccaucugcagcgcgguccccaccgagugguucccgacgucccgcaccaccuggagcauccacgcccaccaccaguggaugaccacggaggacaugcugaagguguggaaccggguguggaucgaggacaaccccaacaugaucgacaagacccccguccacuccugggaggacauccccuaccucggcaagcgcgaggaccuguggugcgggagccugaucggccucuccagccgggccaccugggccaagaacauccacaccgccaucacccaggugcgcaaccugaucggcaaggaggaguacguggacuacaugccggucaugaagcgguacuccgcgcccagcgaguccgagggggugcuguga

SEQ ID NO: 10469 - RNA, 9867 nt, Artificial Sequence
  derived and/or modified CDS sequence (opt1) from DENV-4__FJ639773__SS-prME
agcaccaucacccugcucugccugauccccacggugauggccuuccaccuguccacccgcgacggcgagccgcucaugaucgucgccaagcacgagcgggggcgcccccugcuguucaagaccaccgagggcaucaacaagugcacgcucaucgcgauggaccugggggagaugugcgaggacaccgugaccuacaagugcccccugcucgugaacaccgagcccgaggacaucgacugcuggugcaaccugacgagcaccugggucauguacggcaccugcacccaguccggggagcggcgccgggagaagcgcagcguggcccugacgccgcacuccggcaugggccucgagacccgggccgagaccuggaugagcuccgagggggccuggaagcacgcccagcgcguggagagcuggauccugcggaaccccggcuucgcgcugcucgccggguucauggccuacaugaucggccagaccgggauccagcgcacggucuucuucgugcugaugaugcugguggcccccuccuacggcaugcggugcgucggcguggggaaccgcgacuucguggagggcgucagcgggggcgcguggguggaccucgugcuggagcacggcgggugcgucaccaccauggcccagggcaagcccacccuggacuucgagcucacgaagaccaccgccaaggagguggcccugcugcggaccuacugcaucgaggcccucaucuccaacaucacgaccgcgacccgcugcccgacccagggggagcccuaccugaaggaggagcaggaccagcaguacaucugccggcgcgacguggucgaccggggcugggggaacggcugcggccuguucgggaagggcgggguggugacgugcgccaaguucagcugcuccggcaagaucaccgggaaccucguccagaucgagaaccuggaguacaccgugguggucaccgugcacaacggcgacacgcacgccgucggcaacgacaccagcaaccacggggugaccgccaccaucacgccccgcucccccagcguggaggucaagcugccggacuacggcgagcucacccuggacugcgagccccgguccgggaucgacuucaacgagaugauccugaugaagaugaagaagaagaccuggcucgugcacaagcagugguuccuggaccugccccuccccuggaccaccggcgccgacacgagcgaggugcacuggaacuacaaggagcgcauggucaccuucaaggugccgcacgcgaagcggcaggacgugaccguccuggggucccaggagggcgccaugcacagcgcccuggccggcgccaccgagguggacagcggggacggcaaccacauguucgcggggcaccucaagugcaaggugcgcauggagcgccugcggaucaagggcauguccuacacgaugugcagcggcaaguucuccaucgacaaggagauggccgagacccagcacgggaccaccgucgugaaggugaaguacgagggcgccggggcccccugcaagguccccaucgagauccgcgacgugaacaaggagaagguggucggccgggugaucagcgccacgccccuggcggagaacaccaacuccgugaccaacaucgagcucgagccgcccuucggggacagcuacaucgucaucggcgugggcaacuccgcccugacccugcacugguuccgcaaggggagcuccaucggcaagauguucgagagcacguaccggggggccaagcgcauggccauccucggcgagaccgcgugggacuucggguccgugggcggccuguucaccagccuggggaaggccguccaccagguguucggcuccguguacaccacgauguucgggggcgucagcuggaugauccggauccucaucggguuccuggugcuguggaucggcaccaacucccgcaacaccagcauggccaugaccugcaucgccgugggcgggaucacgcuguuccucggcuucaccguccaggccgacauggggugcgugguguccuggagcggccgggagcugaagugcggguccggcaucuucgucguggacaacgugcacaccuggaccgagcaguacaaguuccagcccgagagccccgcgcgccuggccagcgccauccucaacgcccacaaggacggcgucugcgggauccgguccacgacccgccuggagaacgugauguggaagcagaucaccaacgagcugaacuacgugcucugggagggcgggcacgaccugaccgucguggccggcgacgugaagggcguccugacgaaggggaagcgggcgcucaccccgcccgccagcgaccugaaguacuccuggaagaccuggggcaaggccaagaucuucacccccgaggcccgcaacagcacguuccugaucgacgggcccgacaccuccgagugcccgaacgagcggcgcgccuggaacagcuucgagguggaggacuacggcuucgggauguucaccaccaacaucuggaugaaguuccgggagggcuccagcgaggugugcgaccaccgccucauguccgcggccaucaaggaccagaaggccguccacgccgacaugggcuacuggaucgagagcuccaagaaccagacguggcagaucgagcgggcgagccugaucgaggugaagaccugccuguggcccaagacccacacccucugguccaacggggugcuggagagccagaugcugauccccaaguccuacgccggcccguucagccagcacaacuaccgccagggguacgccacccagacggucggccccuggcaccucgggaagcuggagaucgacuucggcgagugccccggcaccaccgugaccauccaggaggacugcgaccaccgcgggcccucccugcggacgaccaccgccagcggcaagcucgugacccaguggugcugccgcagcugcacgaugccgccccugcgguuccugggggaggacggcugcugguacgggauggagauccgcccccucuccgagaaggaggagaacauggucaagagccaggugaccgccggccagggcaccuccgagaccuucagcauggggcugcugugccucacgcuguucgucgaggagugccugcggcgccgggugacccgcaagcacaugauccucgcgguggucaucacccugugcgccaucauccugggcgggcucaccuggauggaccugcugcgggcccucaucaugcugggcgacacgauguccggccgcaucgggggccagacccaccuggccaucauggccguguucaagaugagccccggguacgugcucggcgucuuccugcggaagcugaccucccgcgagaccgcgcucauggugaucgggauggccaugacgaccacccugagcaucccgcacgaccugauggagcucaucgacggcaucucccugggccugauccuccugaagaucgugacccaguucgacaacacgcaggucgggacccuggcccucagccugaccuucauccgguccaccaugagccuggugauggccuggcgcacgaucauggccgugcucuucgucgugacccugaucccccugugccggaccuccugccuccagaagcagagccacuggguggagaucaccgcgcugauccugggcgcccaggcccuccccgucuaccugaugacgcugaugaagggggccucccgccggagcuggccccucaacgagggcaucauggcgguggggcuggugucccugcucggcagcgcccugcugaagaacgacgucccgcucgccggccccaugguggccgggggccugcugcucgccgcguacgugauguccgggagcagcgccgaccugucccuggagaaggccgccaacguccagugggacgagauggccgacaucaccggcagcucccccaucaucgaggugaagcaggacgaggacgggagcuucuccauccgcgacguggaggagaccaacaugaucacccuccuggucaagcuggcgcucaucacggugagcggccuguacccccuggccaucccggugaccaugacccucugguacauguggcaggucaagacccagcgguccggcgcccugugggacgugcccagccccgccaccacgcagaaggccgcgcuguccgaggggguguaccgcaucaugcagcggggccucuucgggaagacccaggucggcguggggauccacauggagggcguguuccacaccauguggcacgucacccgcggcagcgugaucugccacgagacggggcgccuggagcccuccugggccgacgugcggaacgacaugaucagcuacggcgggggcuggcgccugggcgacaagugggacaaggaggaggacguccaggugcucgccaucgagccggggaagaaccccaagcacgugcagaccaagcccggccuguucaagacccugaccggggagaucggcgccgucacgcucgacuucaagcccgggaccuccggcagcccgaucaucaaccggaagggcaaggugaucgggcuguacggcaacgggguggucaccaaguccggcgacuacgugagcgccaucacccaggcggagcgcaucggggagcccgacuacgagguggacgaggacaucuuccggaagaagcgccugacgaucauggaccuccaccccggcgccggcaagaccaagcggauccugccguccaucguccgcgaggcccugaagcggcgccugcggacccucauccuggcccccacccgcgugguggcggccgagauggaggaggcccugcgggggcuccccauccgcuaccagacgcccgccgucaagagcgagcacaccggccgggagaucguggaccugaugugccacgccaccuucaccacgcgccugcucuccagcacccgggugccgaacuacaaccugaucgucauggacgaggcgcacuucaccgaccccagcuccguggccgcccgcggguacaucagcacccgggucgagaugggcgaggccgccgcgaucuucaugacggccaccccccccggggccaccgacccguucccccaguccaacagccccaucgaggacaucgagcgcgagauccccgagcgcuccuggaacaccggcuucgacuggaucacggacuaccagggcaagaccgugugguucgugccgagcaucaaggccgggaacgacaucgccaacugccugcggaaguccggcaagaaggucauccagcucagccgcaagaccuucgacaccgaguaccccaagacgaagcugaccgacugggacuucguggugaccaccgacaucuccgagaugggggcgaacuuccgggccggccgcgucaucgacccccggcgcugccugaagcccgugauccucacggacgggccggagcgggugauccuggccggccccauccccgucacccccgccagcgcggcccagcgccggggccgcaucgggcggaacccggcccaggaggacgaccaguacguguucuccggcgacccccugaagaacgacgaggaccacgcccacuggaccgaggccaagaugcuccuggacaacaucuacacccccgaggggaucauccccacgcuguucggcccggagcgcgagaagacccaggcgaucgacggcgaguuccggcuccgcggggagcagcggaagaccuucguggagcugaugcgccggggcgaccugcccgucuggcucagcuacaagguggccuccgccgggaucagcuacaaggaccgcgaguggugcuucaccggcgagcggaacaaccagauccuggaggagaacauggagguggagaucuggacccgcgagggggagaagaagaagcugcggcccaaguggcucgacgcccgcgucuacgccgaccccauggcgcugaaggacuucaaggaguucgccuccggccgcaagagcaucacgcuggacauccucaccgagaucgccucccugccgaccuaccugagcucccgggccaagcucgcccuggacaacaucgugaugcugcacaccacggagcgcggcgggcgggcguaccagcacgcccucaacgagcugcccgagagccuggagacccucaugcugguggcccugcucggcgccaugaccgcggggaucuuccuguucuucaugcagggcaaggggaucggcaagcugagcaugggccucaucaccaucgccgucgccuccgggcugcuguggguggccgagauccagccccaguggaucgccgcgagcaucauccucgaguucuuccugauggugcugcucaucccggagcccgagaagcagcgcacgccccaggacaaccagcugaucuacgucauccugaccauccucaccaucaucggccugaucgccgccaacgagauggggcugaucgagaagaccaagacggacuucggcuucuaccaggagaagaccgagaccaccauccucgacguggaccugcggcccgccuccgccuggacgcuguacgcgguggccaccaccauccucaccccgaugcugcgccacacgaucgagaacaccagcgccaaccugucccucgccgccaucgcgaaccaggccgccguccugauggggcugggcaagggcuggccccuccaccggauggaccugggggugccccugcucgccaugggcugcuacagccaggugaaccccaccacccugacggccucccuggucaugcuccuggugcacuacgcgaucaucgggccgggccugcaggccaaggccacccgcgaggcccagaagcggaccgcggccggcaucaugaagaaccccaccguggacgggaucacggucaucgaccucgagcccaucagcuacgaccccaaguucgagaagcagcugggccaggugaugcugcucgugcugugcgccgggcagcugcuccugaugcgcaccaccugggccuucugcgagguccugacccucgccacgggcccgauccugacccugugggaggggaaccccggccgguucuggaacaccaccaucgcgguguccacggccaacaucuuccgcggcagcuaccucgccggggccggccuggccuucucccugaucaagaacgcgcagaccccccggcgcgggaccggcaccaccggggagacgcucggcgagaaguggaagcggcagcugaacagccuggaccgcaaggaguucgaggaguacaagcgguccggcauccucgagguggaccgcaccgaggccaagagcgcccugaaggacggguccaagaucaagcacgccgucagccggggcuccagcaagauccgcuggaucguggagcgcgggauggugaagcccaagggcaaggucguggaccuggggugcggccggggcgggugguccuacuacauggccacccucaagaacgugaccgaggucaagggcuacacgaaggggggcccggggcacgaggagcccauccccauggcgaccuacggcuggaaccuggugaagcugcacagcggcguggacgucuucuacaagcccaccgagcagguggacacccuccugugcgacaucggggagagcuccagcaacccgacgaucgaggagggccgcacccugcgggugcucaagauggucgagcccuggcuguccagcaagcccgaguucugcaucaaggugcugaaccccuacaugccgaccgugaucgaggagcuggagaagcuccagcgcaagcacgggggcaaccugguccggugcccccugucccgcaacagcacccacgagauguacuggguguccggcgccagcgggaacaucgucuccagcgugaacacgaccuccaagaugcuccugaaccgguucaccacccgccaccggaagcccacguacgagaaggacguggaccugggcgccgggacccgcagcgucuccaccgagaccgagaagcccgacaugacgaucaucggccggcgccuccagcggcugcaggaggagcacaaggagaccuggcacuacgaccaggagaacccguaccgcaccugggccuaccacgggagcuacgaggcgcccuccaccggcagcgccuccagcauggugaacggcguggucaagcugcucacgaagcccugggacgugaucccgauggugacccagcuggccaugaccgacaccacgcccuucgggcagcagcgggucuucaaggagaagguggacacccgcaccccccagcccaagccgggcacccggauggugaugacgaccaccgccaacuggcugugggcccuccuggggaagaagaagaacccccgccugugcacccgggaggaguucaucuccaagguccgcagcaacgcggccaucggcgccguguuccaggaggagcagggguggacgagcgccuccgaggccgugaacgacagccgguucugggagcucgucgacaaggagcgcgcgcugcaccaggagggcaagugcgaguccugcguguacaacaugaugggcaagcgcgagaagaagcugggggaguucggccgggccaaggggagccgcgccaucugguacauguggcucggcgcccgguuccuggaguucgaggcccugggguuccucaacgaggaccacugguucggccgcgagaacuccuggagcggcguggagggggagggccugcaccggcugggguacauccucgaggagaucgacaagaaggacggcgaccugauguacgcggacgacaccgccggcugggacacccgcaucaccgaggacgaccugcagaacgaggagcucaucaccgagcagauggccccccaccacaagauccuggccaaggcgaucuucaagcugacguaccagaacaaggucgugaaggugcuccggcccaccccgcgcggggccgucauggacaucaucucccggaaggaccagcgcggcagcgggcaggugggcaccuacgggcugaacaccuucacgaacauggaggugcagcugauccggcagauggaggccgagggcgucaucacccaggacgacaugcagaaccccaagggccucaaggagcgcguggagaaguggcugcgggagugcgggguggaccgccugaagcggauggccaucuccggcgacgacugcgucgugaagccccucgacgagcgcuucgggaccagccugcuguuccucaacgacaugggcaaggugcggaaggacaucccccagugggagccguccaagggguggaagaacuggcaggagguccccuucugcagccaccacuuccacaagaucuucaugaaggacggccgcucccugguggugcccugccggaaccaggacgagcugaucggccgcgcccgcaucagccagggggcgggcuggucccuccgggagaccgccugccuggggaaggccuacgcccagauguggagccugauguacuuccaccgccgggaccuccgccuggccuccauggcgaucugcagcgccguccccacggagugguucccgaccagccggaccaccugguccauccacgcccaccaccaguggaugacgaccgaggacaugcugaagguguggaaccgcguguggaucgaggacaaccccaacaugaucgacaagacccccguccacagcugggaggacauccccuaccucggcaagcgggaggaccuguggugcgggucccugaucggccucagcucccgcgccaccugggccaagaacauccacacggcgaucacccaggugcggaaccugaucggcaaggaggaguacguggacuacaugccggucaugaagcgcuacagcgcccccuccgagagcgagggggugcuguga

SEQ ID NO: 10470 - RNA, 9867 nt, Artificial Sequence
  derived and/or modified CDS sequence (opt1) from DENV-4__FJ882580__SS-prME
agcaccaucacccugcucugccugauccccacggugauggccuuccaccuguccacccgcgacggcgagccgcucaugaucgucgccaagcacgagcgggggcgcccccugcuguucaagaccaccgagggcaucaacaagugcacgcucaucgcgauggaccugggggagaugugcgaggacaccgugaccuacaagugcccccugcucgugaacaccgagcccgaggacaucgacugcuggugcaaccugacgagcaccugggucauguacggcaccugcacccaguccggggagcggcgccgggagaagcgcagcguggcccugacgccgcacuccggcaugggccucgagacccgggccgagaccuggaugagcuccgagggggccuggaagcacgcccagcgcguggagagcuggauccugcggaaccccggcuucgcgcugcucgccggguucauggccuacaugaucggccagaccgggauccagcgcacggucuucuucgugcugaugaugcugguggcccccuccuacggcaugcggugcgucggcguggggaaccgcgacuucguggagggcgucagcgggggcgcguggguggaccucgugcuggagcacggcgggugcgucaccaccauggcccagggcaagcccacccuggacuucgagcucacgaagaccaccgccaaggagguggcccugcugcggaccuacugcaucgaggcccucaucuccaacaucacgaccgcgacccgcugcccgacccagggggagcccuaccugaaggaggagcaggaccagcaguacaucugccggcgcgacguggucgaccggggcugggggaacggcugcggccuguucgggaagggcgggguggugacgugcgccaaguucagcugcuccggcaagaucaccgggaaccucguccagaucgagaaccuggaguacaccgugguggucaccgugcacaacggcgacacgcacgccgucggcaacgacaccagcaaccacggggugaccgccaccaucacgccccgcucccccagcguggaggucaagcugccggacuacggcgagcucacccuggacugcgagccccgguccgggaucgacuucaacgagaugauccugaugaagaugaagaagaagaccuggcucgugcacaagcagugguuccuggaccugccccuccccuggaccaccggcgccgacacgagcgaggugcacuggaacuacaaggagcgcauggucaccuucaaggugccgcacgcgaagcggcaggacgugaccguccuggggucccaggagggcgccaugcacagcgcccuggccggcgccaccgagguggacagcggggacggcaaccacauguucgcggggcaccucaagugcaaggugcgcauggagaagcugcgcaucaagggcauguccuacacgaugugcagcggcaaguucuccaucgacaaggagauggccgagacccagcacgggaccaccgucgugaaggugaaguacgagggcgccggggcccccugcaagguccccaucgagauccgggacgugaacaaggagcgcguggucggccgggugaucagcgccacgccccuggcggagaacaccaacuccgugaccaacaucgagcucgagccgcccuucggggacagcuacaucgucaucggcgugggcaacuccgcccugacccugcacugguuccgcaaggggagcuccaucggcaagauguucgagagcacguaccggggggccaagcgcauggccauccucggcgagaccgcgugggacuucggguccgugggcggccuguucaccagccuggggaaggccguccaccagguguucggcuccguguacaccacgauguucgggggcgucagcuggaugauccggauccucaucggguuccuggugcuguggaucggcaccaacucccgcaacaccagcauggccaugaccugcaucgccgugggcgggaucacgcuguuccucggcuucaccguccaggccgacauggggugcgugguguccuggagcggccgggagcugaagugcggguccggcaucuucgucguggacaacgugcacaccuggaccgagcaguacaaguuccagcccgagagccccgcgcgccuggccagcgccauccucaacgcccacaaggacggcgucugcgggauccgguccacgacccgccuggagaacgugauguggaagcagaucaccaacgagcugaacuacgugcucugggagggcgggcacgaccugaccaucgucgccggcgacgugaagggcgugcugacgaaggggaagcgggcgcucaccccgcccgccagcgaccugaaguacuccuggaagaccuggggcaaggccaagaucuucacccccgaggcccgcaacagcacguuccugaucgacgggcccgacaccuccgagugcccgaacgagcggcgcgccuggaacagcuucgaggucgaggacuacggcuucgggauguucaccaccaacaucuggaugaaguuccgggagggcuccagcgaggugugcgaccaccgccucauguccgcggccaucaaggaccagaaggccgugcacgccgacaugggcuacuggaucgagagcuccaagaaccagacguggcagaucgagcgggcgagccugaucgaggucaagaccugccuguggcccaagacccacacccucugguccaacggggugcuggagagccagaugcugauccccaaguccuacgccggcccguucagccagcacaacuaccgccagggguacgccacccagacggugggccccuggcaccucgggaagcuggagaucgacuucggcgagugccccggcaccaccgucaccauccaggagaacugcgaccaccgcgggcccucccugcggacgaccaccgccagcggcaagcucgugacccaguggugcugccgcagcugcacgaugccgccccugcgguuccugggggaggacggcugcugguacgggauggagauccgcccccucuccgagaaggaggagaacauggugaagagccaggucaccgccggccagggcaccuccgagaccuucagcauggggcugcugugccucacgcuguucguggaggagugccugcggcgccgggucacccgcaagcacaugauccucgcgguggugaucacccugugcgccaucauccugggcgggcucaccuggauggaccugcugcgggcccucaucaugcugggcgacacgauguccggccgcaucgggggccagacccaccuggccaucauggccgucuucaagaugagccccggguacgugcucggcguguuccugcggaagcugaccucccgcgagaccgcgcucauggucaucgggauggccaugacgaccacccugagcaucccgcacgaccugauggagcucaucgacggcaucucccugggccugauccuccugaagaucgugacccaguucgacaacacgcagguggggacccuggcccucagccugaccuucauccgguccaccaugagccuggucauggccuggcgcacgaucauggccgugcucuucguggucacccugaucccccugugccggaccuccugccuccagaagcagagccacuggguggagaucaccgcgcugauccugggcgcccaggcccuccccguguaccugaugacgcugaugaagggggccucccgccggagcuggccccucaacgagggcaucauggcggucgggcuggugucccugcucggcagcgcccugcugaagaacgacgugccgcucgccggccccauggucgccgggggccugcugcucgccgcguacgugauguccgggagcagcgccgaccugucccuggagaaggccgccaacgugcagugggacgagauggccgacaucaccggcagcucccccaucaucgaggucaagcaggacgaggacgggagcuucuccauccgcgacguggaggagaccaacaugaucacccuccuggugaagcuggcgcucaucacggucagcggccuguacccccuggccaucccgaucaccaugacccucugguacauguggcaggugaagacccagcgguccggcgcccugugggacgugcccagccccgccgccacccagaaggcggcccuguccgagggggucuaccgcaucaugcagcggggccucuucgggaagacgcaggugggcguggggauccacauggagggcgucuuccacaccauguggcacgugacccgcggcagcgugaucugccacgagaccgggcgccuggagcccuccugggccgacguccggaacgacaugaucagcuacggcgggggcuggcgccugggcgacaagugggacaaggaggaggacgugcaggugcucgccaucgagccggggaagaaccccaagcacguccagacgaagcccggccuguucaagacccugaccggggagaucggcgccgugacccucgacuucaagcccgggacguccggcagcccgaucaucaaccggaagggcaaggugaucgggcuguacggcaacggggucgugaccaaguccggcgacuacgugagcgcgaucacccaggccgagcgcaucggggagcccgacuacgaggucgacgaggacaucuuccggaagaagcgccugaccaucauggaccuccaccccggcgccggcaagacgaagcggauccugccguccaucgugcgcgaggcccugaagcggcgccugcggacccucauccuggcgcccacccgcguggucgccgccgagauggaggaggcccugcgggggcuccccauccgcuaccagacccccgccgugaagagcgagcacacgggccgggagaucguggaccugaugugccacgcgaccuucaccacccgccugcucuccagcacgcgggucccgaacuacaaccugaucgugauggacgaggcccacuucaccgaccccagcuccguggccgcccgcggguacaucagcacccgggucgagaugggcgaggccgcggccaucuucaugaccgccacgccccccggggccaccgacccguucccccaguccaacagccccaucgaggacaucgagcgcgagauccccgagcgcuccuggaacaccggcuucgacuggaucaccgacuaccagggcaagacggugugguucgucccgagcaucaaggccgggaacgacaucgcgaacugccugcggaaguccggcaagaaggugauccagcucagccgcaagaccuucgacaccgaguaccccaagaccaagcugacggacugggacuucguggucaccaccgacaucuccgagaugggggccaacuuccgggccggccgcgugaucgacccccggcgcugccugaagcccgugauccucaccgacgggccggagcgggucauccuggccggccccauccccgugacgcccgcgagcgccgcccagcgccggggccgcaucgggcggaacccggcccaggaggacgaccaguacguguucuccggcgacccccugaagaacgacgaggaccacgcccacuggaccgaggcgaagaugcuccuggacaacaucuacacccccgaggggaucauccccacccuguucggcccggagcgcgagaagacgcaggccaucgacggcgaguuccggcuccgcggggagcagcggaagaccuucgucgagcugaugcgccggggcgaccugcccguguggcucagcuacaagguggccuccgccgggaucagcuacaaggaccgcgaguggugcuucaccggcgagcggaacaaccagauccuggaggagaacauggaggucgagaucuggacccgcgagggggagaagaagaagcugcggcccaaguggcucgacgcccgcguguacgcggaccccauggcccugaaggacuucaaggaguucgccuccggccgcaagagcaucacccuggacauccucacggagaucgccucccugccgaccuaccugagcucccgggccaagcucgcgcuggacaacaucgugaugcugcacaccaccgagcgcggcgggcgggccuaccagcacgcccucaacgagcugcccgagagccuggagacgcucaugcuggucgcccugcucggcgcgaugaccgccgggaucuuccuguucuucaugcagggcaaggggaucggcaagcugagcaugggccucaucaccaucgccguggccuccgggcugcuguggguggccgagauccagccccaguggaucgcggccagcaucauccucgaguucuuccugaugguccugcucaucccggagcccgagaagcagcgcaccccccaggacaaccagcugaucuacgugauccugacgauccucaccaucaucggccugaucgccgccaacgagauggggcugaucgagaagaccaagaccgacuucggcuucuaccaggugaagacggagaccaccauccucgacgucgaccugcggcccgccuccgcguggacccuguacgccguggccacgaccauccucaccccgaugcugcgccacaccaucgagaacacgagcgccaaccugucccucgccgcgaucgccaaccaggccgccgugcugauggggcugggcaagggcuggccccuccaccggauggaccugggggucccccugcucgccaugggcugcuacagccaggugaaccccaccacccugaccgcgucccuggugaugcuccugguccacuacgccaucaucgggccgggccugcaggccaaggccacgcgcgaggcgcagaagcggaccgccgccggcaucaugaagaaccccaccguggacgggaucaccgugaucgaccucgagcccaucagcuacgaccccaaguucgagaagcagcugggccaggucaugcugcucgugcugugcgccgggcagcugcuccugaugcgcacgaccugggccuucugcgaggugcugacccucgcgaccggcccgauccugacgcugugggaggggaaccccggccgguucuggaacaccaccaucgccgucuccaccgccaacaucuuccgcggcagcuaccucgccggggccggccuggcguucucccugaucaagaacgcccagacgccccggcgcgggaccggcaccaccggggagacccucggcgagaaguggaagcggcagcugaacagccuggaccgcaaggaguucgaggaguacaagcgguccggcauccucgagguggaccgcacggaggccaagagcgcccugaaggacggguccaagaucaagcacgccgugagccggggcuccagcaagauccgcuggaucgucgagcgcgggauggugaagcccaagggcaagguggucgaccuggggugcggccggggcgggugguccuacuacauggcgacccucaagaacgugaccgaggugaagggcuacaccaaggggggcccggggcacgaggagcccauccccauggccacguacggcuggaaccuggucaagcugcacagcggcguggacguguucuacaagcccaccgagcaggucgacacccuccugugcgacaucggggagagcuccagcaacccgaccaucgaggagggccgcacgcugcgggugcucaagaugguggagcccuggcuguccagcaagcccgaguucugcaucaagguccugaaccccuacaugccgaccgugaucgaggagcuggagaagcuccagcgcaagcacgggggcaaccuggugcggugcccccugucccgcaacagcacccacgagauguacugggucuccggcgccagcgggaacaucguguccagcgucaacaccacguccaagaugcuccugaaccgguucaccacccgccaccggaagcccaccuacgagaaggacguggaccugggcgccgggacgcgcagcguguccaccgagaccgagaagcccgacaugaccaucaucggccggcgccuccagcggcugcaggaggagcacaaggagacguggcacuacgaccaggagaacccguaccgcaccugggcguaccacgggagcuacgaggcccccuccaccggcagcgccuccagcauggucaacggcguggugaagcugcucaccaagcccugggacgucaucccgauggugacgcagcuggccaugaccgacaccacccccuucgggcagcagcggguguucaaggagaaggucgacacgcgcaccccccagcccaagccgggcacccggauggugaugaccacgaccgccaacuggcugugggcgcuccuggggaagaagaagaacccccgccugugcacccgggaggaguucaucuccaaggugcgcagcaacgccgccaucggcgccgucuuccaggaggagcagggguggaccagcgccuccgaggcggugaacgacagccgguucugggagcucguggacaaggagcgcgcccugcaccaggagggcaagugcgaguccugcgucuacaacaugaugggcaagcgcgagaagaagcugggggaguucggccgggccaaggggagccgcgccaucugguacauguggcucggcgcccgguuccuggaguucgaggcgcugggguuccucaacgaggaccacugguucggccgcgagaacuccuggagcggcguggagggggagggccugcaccggcugggguacauccucgaggagaucgacaagaaggacggcgaccugauguacgccgacgacacggccggcugggacacccgcaucaccgaggacgaccugcagaacgaggagcucaucaccgagcagauggccccccaccacaagauccuggcgaaggccaucuucaagcugaccuaccagaacaagguggucaaggugcuccggcccacgccgcgcggggccgugauggacaucaucucccggaaggaccagcgcggcagcgggcaggucggcaccuacgggcugaacaccuucaccaacauggaggugcagcugauccggcagauggaggccgagggcgugaucacgcaggacgacaugcagaaccccaagggccucaaggagcgcgucgagaaguggcugcgggagugcgggguggaccgccugaagcggauggccaucuccggcgacgacugcguggucaagccccucgacgagcgcuucgggaccagccugcuguuccucaacgacaugggcaaggugcggaaggacaucccccagugggagccguccaagggguggaagaacuggcaggaggugcccuucugcagccaccacuuccacaagaucuucaugaaggacggccgcucccuggucgugcccugccggaaccaggacgagcugaucggccgcgcgcgcaucagccagggggccggcuggucccuccgggagaccgccugccuggggaaggccuacgcccagauguggagccugauguacuuccaccgccgggaccuccgccuggcguccauggccaucugcagcgccgugcccaccgagugguucccgacgagccggaccaccugguccauccacgcccaccaccaguggaugaccacggaggacaugcugaaggucuggaaccgcguguggaucgaggacaaccccaacaugaucgacaagacccccgugcacagcugggaggacauccccuaccucggcaagcgggaggaccuguggugcgggucccugaucggccucagcucccgcgccaccugggcgaagaacauccacaccgccaucacgcagguccggaaccugaucggcaaggaggaguacguggacuacaugccggugaugaagcgcuacagcgcccccuccgagagcgaggggguccuguga

SEQ ID NO: 10471 - RNA, 9867 nt, Artificial Sequence
  derived and/or modified CDS sequence (opt1) from DENV-4__FJ882581__SS-prME
agcaccaucacccugcucugccugauccccacggugauggccuuccaccuguccacccgcgacggcgagccgcucaugaucgucgccaagcacgagcgggggcgcccccugcuguucaagaccaccgagggcaucaacaagugcacgcucaucgcgauggaccugggggagaugugcgaggacaccgugaccuacaagugcccccugcucgugaacaccgagcccgaggacaucgacugcuggugcaaccugacgagcaccugggucauguacggcaccugcacccaguccggggagcggcgccgggagaagcgcagcguggcccugacgccgcacuccggcaugggccucgagacccgggccgagaccuggaugagcuccgagggggccuggaagcacgcccagcgcguggagagcuggauccugcggaaccccggcuucgcgcugcucgccggguucauggccuacaugaucggccagaccgggauccagcgcacggucuucuucgugcugaugaugcugguggcccccuccuacggcaugcggugcgucggcguggggaaccgcgacuucguggagggcgucagcgggggcgcguggguggaccucgugcuggagcacggcgggugcgucaccaccauggcccagggcaagcccacccuggacuucgagcucacgaagaccaccgccaaggagguggcccugcugcggaccuacugcaucgaggcccucaucuccaacaucacgaccgcgacccgcugcccgacccagggggagcccuaccugaaggaggagcaggaccagcaguacaucugccggcgcgacguggucgaccggggcugggggaacggcugcggccuguucgggaagggcgggguggugacgugcgccaaguucagcugcuccggcaagaucaccgggaaccucguccagaucgagaaccuggaguacaccgugguggucaccgugcacaacggcgacacgcacgccgucggcaacgacaccagcaaccacggggugaccgccaccaucacgccccgcucccccagcguggaggucaagcugccggacuacggcgagcucacccuggacugcgagccccgguccgggaucgacuucaacgagaugauccugaugaagaugaagaagaagaccuggcucgugcacaagcagugguuccuggaccugccccuccccuggaccaccggcgccgacacgagcgaggugcacuggaacuacaaggagcgcauggucaccuucaaggugccgcacgcgaagcggcaggacgugaccguccuggggucccaggagggcgccaugcacagcgcccuggccggcgccaccgagguggacagcggggacggcaaccacauguucgcggggcaccucaagugcaaggugcgcauggagaagcugcgcaucaagggcauguccuacacgaugugcagcggcaaguucuccaucgacaaggagauggccgagacccagcacgggaccaccgucgugaaggugaaguacgagggcgccggggcccccugcaagguccccaucgagauccgggacgugaacaaggagaagguggucggccgcgugaucagcgccacgccccuggcggagaacaccaacuccgugaccaacaucgagcucgagccgcccuucggggacagcuacaucgucaucggcgugggcaacuccgcccugacccugcacugguuccggaaggggagcuccaucggcaagauguucgagagcacguaccgcggggccaagcggauggccauccucggcgagaccgcgugggacuucggguccgugggcggccuguucaccagccuggggaaggccguccaccagguguucggcuccguguacaccacgauguucgggggcgucagcuggaugauccgcauccucaucggguuccuggugcuguggaucggcaccaacucccggaacaccagcauggccaugaccugcaucgccgugggcgggaucacgcuguuccucggcuucaccguccaggccgacauggggugcgugguguccuggaacggccgcgagcugaagugcgggagcggcaucuucgucguggacaacgugcacaccuggaccgagcaguacaaguuccagcccgagucccccgcgcggcuggccagcgccauccucaacgcccacaaggacggcgucugcgggauccgcagcacgacccggcuggagaacgugauguggaagcagaucaccaacgagcugaacuacgugcucugggagggcgggcacgaccugaccgucguggccggcgacgugaagggcguccugacgaaggggaagcgcgcgcucaccccgcccgccuccgaccugaaguacagcuggaagaccuggggcaaggccaagaucuucacccccgaggcccggaacuccacguuccugaucgacgggcccgacaccagcgagugcccgaacgagcgccgggccuggaacuccuucgagguggaggacuacggcuucgggauguucaccaccaacaucuggaugaaguuccgcgagggcagcuccgaggugugcgaccaccggcucaugagcgcggccaucaaggaccagaaggccguccacgccgacaugggcuacuggaucgaguccagcaagaaccagacguggcagaucgagcgcgcgucccugaucgaggugaagaccugccuguggcccaagacccacacccucuggagcaacggggugcuggagucccagaugcugauccccaagagcuacgccggcccguucucccagcacaacuaccggcagggguacgccacccagacggucggccccuggcaccucgggaagcuggagaucgacuucggcgagugccccggcaccaccgugaccauccaggagaacugcgaccaccgcgggcccagccugcgcacgaccaccgccuccggcaagcucgugacccaguggugcugccggagcugcacgaugccgccccugcgcuuccugggggaggacggcugcugguacgggauggagauccggccccucagcgagaaggaggagaacauggucaagucccaggugaccgccggccagggcaccagcgagaccuucuccauggggcugcugugccucacgcuguucgucgaggagugccugcgccggcgcgugacccggaagcacaugauccucgcgguggucaucacccugugcgccaucauccugggcgggcucaccuggauggaccugcugcgcgcccucaucaugcugggcgacacgaugagcggccggaucgggggccagacccaccuggccaucauggccguguucaagaugucccccggguacgugcucggcgucuuccugcgcaagcugaccagccgggagaccgcgcucauggugaucgggauggccaugacgaccacccuguccaucccgcacgaccugauggagcucaucgacggcaucagccugggccugauccuccugaagaucgugacccaguucgacaacacgcaggucgggacccuggcccucucccugaccuucauccgcagcaccaugucccuggugauggccuggcggacgaucauggccgugcucuucgucgugacccugaucccccugugccgcaccagcugccuccagaagcagucccacuggguggagaucaccgcgcugauccugggcgcccaggcccuccccgucuaccugaugacgcugaugaagggggccagccggcgcuccuggccccucaacgagggcaucauggcgguggggcuggugagccugcucggcuccgcccugcugaagaacgacgucccgcucgccggccccaugguggccgggggccugcugcucgccgcguacgugaugagcggguccagcgccgaccugagccuggagaaggccgccaacguccagugggacgagauggccgacaucaccggcuccagccccaucaucgaggugaagcaggacgaggacggguccuucagcauccgggacguggaggagaccaacaugaucacccuccuggucaagcuggcgcucaucacgguguccggccuguacccccuggccaucccgaucaccaugacccucugguacauguggcaggugaagacccagcgcagcggcgcccugugggacguccccucccccgccgccacccagaaggcggcccugagcgaggggguguaccggaucaugcagcgcggccucuucgggaagacgcaggugggcgucgggauccacauggagggcguguuccacaccauguggcacgugacccggggcuccgucaucugccacgagaccgggcgccuggagcccagcugggccgacgugcgcaacgacaugaucuccuacggcgggggcuggcggcugggcgacaagugggacaaggaggaggacgugcagguccucgccaucgagccggggaagaaccccaagcacgugcagacgaagcccggccuguucaagacccugaccggggagaucggcgccgugacccucgacuucaagcccgggacgagcggcuccccgaucaucaaccgcaagggcaaggucaucgggcuguacggcaacgggguggugaccaagagcggcgacuacgucuccgcgaucacccaggccgagcggaucggggagcccgacuacgagguggacgaggacaucuuccgcaagaagcggcugaccaucauggaccuccaccccggcgccggcaagacgaagcgcauccugccgagcaucgugcgggaggcccugaagcgccggcugcgcacccucauccuggcgcccacccgggucguggccgccgagauggaggaggcccugcgcgggcuccccauccgguaccagacccccgccgugaaguccgagcacacgggccgcgagaucgucgaccugaugugccacgcgaccuucaccacccggcugcucagcuccacgcgcgugccgaacuacaaccugaucgugauggacgaggcccacuucaccgaccccagcagcgucgccgcccggggguacaucuccacccgcguggagaugggcgaggccgcggccaucuucaugaccgccacgccccccggggccaccgacccguucccccagagcaacucccccaucgaggacaucgagcgggagauccccgagcgcagcuggaacaccggcuucgacuggaucaccgacuaccagggcaagacggucugguucgugccguccaucaaggccgggaacgacaucgcgaacugccugcgcaagagcggcaagaaggugauccagcucucccggaagaccuucgacaccgaguaccccaagaccaagcugacggacugggacuucgucgugaccaccgacaucagcgagaugggggccaacuuccgcgccggccgggugaucgacccccgccggugccugaagcccgucauccucaccgacgggccggagcgcgugauccuggccggccccauccccgugacgcccgcguccgccgcccagcggcgcggccggaucgggcgcaaccuggcccaggaggacgaccaguacgucuucagcggcgacccgcucaagaacgacgaggaccacgcccacuggaccgaggcgaagaugcugcuggacaacaucuacacccccgaggggaucauccccacccucuucggccccgagcgggagaagacgcaggccaucgacggcgaguuccgccugcggggggagcagcgcaagaccuucguggagcugaugcggcgcggcgaccucccgguguggcuguccuacaaggucgccagcgccgggaucuccuacaaggaccgggaguggugcuucaccggcgagcgcaacaaccagauccuggaggagaacauggagguggagaucuggacccgggagggggagaagaagaagcuccgccccaaguggcuggacgcccggguguacgcggaccccauggcccugaaggacuucaaggaguucgccagcggccgcaaguccaucacccucgacauccugacggagaucgccagccugcccaccuaccucuccagccgcgccaagcuggcgcuggacaacaucgucaugcuccacaccaccgagcggggcgggcgcgccuaccagcacgcccugaacgagcugccggagucccucgagacgcugaugcugguggcccuccugggcgcgaugaccgccgggaucuuccuguucuucaugcagggcaaggggaucggcaagcucagcaugggccugaucaccaucgccguggccagcgggcugcucugggucgccgagauccagccccaguggaucgcggccuccaucauccuggaguucuuccugauggugcuccugauccccgagccggagaagcagcggaccccccaggacaaccagcugaucuacgugauccucacgauccugaccaucaucggccugaucgccgccaacgagauggggcucaucgagaagaccaagaccgacuucggcuucuaccaggucaagacggagaccaccauccuggacguggaccugcgccccgccagcgcguggacccucuacgccguggccacgaccauccugacccccaugcugcggcacaccaucgagaacacguccgccaaccucagccuggccgcgaucgccaaccaggccgccguccugauggggcucggcaagggcuggccgcugcaccgcauggaccugggggugccccuccuggccaugggcugcuacucccaggugaaccccaccacccugaccgcgagccucgucaugcugcuggugcacuacgccaucaucgggcccggccuccaggccaaggccacgcgggaggcgcagaagcgcaccgccgccggcaucaugaagaacccgaccguggacgggaucaccgucaucgaccuggagcccaucuccuacgaccccaaguucgagaagcagcugggccaggugaugcuccuggugcugugcgccgggcagcuccugcugaugcggacgaccugggccuucugcgagguccucacccuggcgaccggccccauccugacgcucugggaggggaacccgggccgcuucuggaacaccaccaucgccgugagcaccgccaacaucuuccggggcuccuaccuggccggggccggccuggcguucagccucaucaagaacgcccagacgccccgccgggggaccggcaccaccggggagacccugggcgagaaguggaagcgccagcugaacucccucgaccggaaggaguucgaggaguacaagcgcagcggcauccuggagguggaccggacggaggccaaguccgcccugaaggacgggagcaagaucaagcacgccgucucccgcggcagcuccaagauccgguggaucguggagcgcgggauggugaagcccaagggcaaggucguggaccucgggugcggccgcggcggguggagcuacuacauggcgacccugaagaacgugaccgaggucaagggcuacaccaaggggggccccgggcacgaggagccgauccccauggccacguacggcuggaaccuggugaagcuccacuccggcguggacgucuucuacaagcccaccgagcagguggacacccugcugugcgacaucggggagagcagcuccaaccccaccaucgaggagggccggacgcuccgcgugcugaagauggucgagccguggcugagcuccaagcccgaguucugcaucaaggugcugaaccccuacaugcccaccgugaucgaggagcucgagaagcugcagcggaagcacgggggcaaccugguccgcugcccgcucagccggaacuccacccacgagauguacugggugagcggcgccuccgggaacaucgucagcuccgugaacaccacgagcaagaugcugcugaaccgcuucaccacccggcaccgcaagcccaccuacgagaaggacguggaccucggcgccgggacgcgguccgucagcaccgagaccgagaagcccgacaugaccaucaucggccgccggcugcagcgccugcaggaggagcacaaggagacguggcacuacgaccaggagaaccccuaccggaccugggcguaccacggguccuacgaggccccgagcaccggcuccgccagcuccauggugaacggcguggucaagcuccugaccaagcccugggacgugauccccauggugacgcagcuggccaugaccgacaccaccccguucgggcagcagcgcgucuucaaggagaagguggacacgcggaccccccagcccaagcccggcacccgcauggugaugaccacgaccgccaacuggcucugggcgcugcuggggaagaagaagaacccgcggcucugcacccgcgaggaguucaucagcaagguccgguccaacgccgccaucggcgccguguuccaggaggagcagggguggaccagcgccagcgaggcggugaacgacucccgcuucugggagcuggucgacaaggagcgggcccugcaccaggagggcaagugcgagagcugcguguacaacaugaugggcaagcgcgagaagaagcucggggaguucggccgcgccaaggggucccgggccaucugguacauguggcugggcgcccgcuuccuggaguucgaggcgcucggguuccugaacgaggaccacugguucggccgggagaacagcugguccggcguggagggggagggccugcaccgccucggguacauccuggaggagaucgacaagaaggacggcgaccugauguacgccgacgacacggccggcugggacacccggaucaccgaggacgaccuccagaacgaggagcugaucaccgagcagauggccccccaccacaagauccuggcgaaggccaucuucaagcucaccuaccagaacaaggucgugaaggugcugcgccccacgccccggggggccgucauggacaucaucagccgcaaggaccagcggggcuccgggcaggugggcaccuacgggcugaacaccuucaccaacauggaggugcagcucauccgccagauggaggccgagggcgucaucacgcaggacgacaugcagaacccgaagggccugaaggagcggguggagaaguggcugcgcgagugcgggguggaccggcucaagcgcauggccaucagcggcgacgacugcgucgugaagccccuggacgagcgguucgggaccucccugcucuuccugaacgacaugggcaaggugcgcaaggacaucccccagugggagcccagcaagggguggaagaacuggcaggaggucccguucugcucccaccacuuccacaagaucuucaugaaggacggccggagccugguggugcccugccgcaaccaggacgagcucaucggccgggcgcgcaucucccagggggccggcuggagccugcgcgagaccgccugccuggggaaggccuacgcccagauguggucccucauguacuuccaccggcgcgaccugcggcuggcgagcauggccaucugcuccgccguccccaccgagugguuccccacgagccgcaccaccuggagcauccacgcccaccaccaguggaugaccacggaggacaugcucaagguguggaaccggguguggaucgaggacaacccgaacaugaucgacaagacccccguccacuccugggaggacauccccuaccugggcaagcgcgaggaccuguggugcgggagccucaucggccuguccagccgggccaccugggcgaagaacauccacaccgccaucacgcaggugcgcaaccugaucggcaaggaggaguacguggacuacaugcccgucaugaagcgguacuccgccccgagcgaguccgagggggugcucuga

SEQ ID NO: 10472 - RNA, 9867 nt, Artificial Sequence
  derived and/or modified CDS sequence (opt1) from DENV-4__FJ882582__SS-prME
agcaccaucacccugcucugccugauccccacggugauggccuuccaccuguccacccgcgacggcgagccgcucaugaucgucgccaagcacgagcgggggcgcccccugcuguucaagaccaccgagggcaucaacaagugcacgcucaucgcgauggaccugggggagaugugcgaggacaccgugaccuacaagugcccccugcucgugaacaccgagcccgaggacaucgacugcuggugcaaccugacgagcaccugggucauguacggcaccugcacccaguccggggagcggcgccgggagaagcgcagcguggcccugacgccgcacuccggcaugggccucgagacccgggccgagaccuggaugagcuccgagggggccuggaagcacgcccagcgcguggagagcuggauccugcggaaccccggcuucgcgcugcucgccggguucauggccuacaugaucggccagaccgggauccagcgcacggucuucuucgugcugaugaugcugguggcccccuccuacggcaugcggugcgucggcguggggaaccgcgacuucguggagggcgucagcgggggcgcguggguggaccucgugcuggagcacggcgggugcgucaccaccauggcccagggcaagcccacccuggacuucgagcucacgaagaccaccgccaaggagguggcccugcugcggaccuacugcaucgaggcccucaucuccaacaucacgaccgcgacccgcugcccgacccagggggagcccuaccugaaggaggagcaggaccagcaguacaucugccggcgcgacguggucgaccggggcugggggaacggcugcggccuguucgggaagggcgggguggugacgugcgccaaguucagcugcuccggcaagaucaccgggaaccucguccagaucgagaaccuggaguacaccgugguggucaccgugcacaacggcgacacgcacgccgucggcaacgacaccagcaaccacggggugaccgccaccaucacgccccgcucccccagcguggaggucaagcugccggacuacggcgagcucacccuggacugcgagccccgguccgggaucgacuucaacgagaugauccugaugaagaugaagaagaagaccuggcucgugcacaagcagugguuccuggaccugccccuccccuggaccaccggcgccgacacgagcgaggugcacuggaacuacaaggagcgcauggucaccuucaaggugccgcacgcgaagcggcaggacgugaccguccuggggucccaggagggcgccaugcacagcgcccuggccggcgccaccgagguggacagcggggacggcaaccacauguucgcggggcaccucaagugcaaggugcgcauggagaagcugcgcaucaagggcauguccuacacgaugugcagcggcaaguucuccaucgacaaggagauggccgagacccagcacgggaccaccgucgugaaggugaaguacgagggcgccggggcccccugcaagguccccaucgagauccgggacgugaacaaggagaagguggucggccgcgugaucagcgccacgccccuggcggagaacaccaacuccgugaccaacaucgagcucgagccgcccuucggggacagcuacaucgucaucggcgugggcaacuccgcccugacccugcacugguuccggaaggggagcuccaucggcaagauguucgagagcacguaccgcggggccaagcggauggccauccucggcgagaccgcgugggacuucggguccgugggcggccuguucaccagccuggggaaggccguccaccagguguucggcuccguguacaccacgauguucgggggcgucagcuggaugauccgcauccucaucggguuccuggugcuguggaucggcaccaacucccggaacaccagcauggccaugaccugcaucgccgugggcgggaucacgcuguuccucggcuucaccguccaggccgacauggggugcgugguguccuggaacggccgcgagcugaagugcgggagcggcaucuucgucguggacaacgugcacaccuggaccgagcaguacaaguuccagcccgagucccccgcgcggcuggccagcgccauccucaacgcccacaaggacggcgucugcgggauccgcagcacgacccggcuggagaacgugauguggaagcagaucaccaacgagcugaacuacgugcucugggagggcgggcacgaccugaccgucguggccggcgacgugaagggcguccugacgaaggggaagcgcgcgcucaccccgcccgccuccgaccugaaguacagcuggaagaccuggggcaaggccaagaucuucacccccgaggcccggaacuccacguuccugaucgacgggcccgacaccagcgagugcccgaacgagcgccgggccuggaacuccuucgagguggaggacuacggcuucgggauguucaccaccaacaucuggaugaaguuccgcgagggcagcuccgaggugugcgaccaccggcucaugagcgcggccaucaaggaccagaaggccguccacgccgacaugggcuacuggaucgaguccagcaagaaccagacguggcagaucgagcgcgcgucccugaucgaggugaagaccugccuguggcccaagacccacacccucuggagcaacggggugcuggagucccagaugcugauccccaagagcuacgccggcccguucucccagcacaacuaccggcagggguacgccacccagacggucggccccuggcaccucgggaagcuggagaucgacuucggcgagugccccggcaccaccgugaccauccaggagaacugcgaccaccgcgggcccagccugcgcacgaccaccgccuccggcaagcucgugacccaguggugcugccggagcugcacgaugccgccccugcgcuuccugggggaggacggcugcugguacgggauggagauccggccccucagcgagaaggaggagaacauggucaagucccaggugaccgccggccagggcaccagcgagaccuucuccauggggcugcugugccucacgcuguucgucgaggagugccugcgccggcgcgugacccggaagcacaugauccucgcgguggucaucacccugugcgccaucauccugggcgggcucaccuggauggaccugcugcgcgcccucaucaugcugggcgacacgaugagcggccggaucgggggccagacccaccuggccaucauggccguguucaagaugucccccggguacgugcucggcgucuuccugcgcaagcugaccagccgggagaccgcgcucauggugaucgggauggccaugacgaccacccuguccaucccgcacgaccugauggagcucaucgacggcaucagccugggccugauccuccugaagaucgugacccaguucgacaacacgcaggucgggacccuggcccucucccugaccuucauccgcagcaccaugucccuggugauggccuggcggacgaucauggccgugcucuucgucgugacccugaucccccugugccgcaccagcugccuccagaagcagucccacuggguggagaucaccgcgcugauccugggcgcccaggcccuccccgucuaccugaugacgcugaugaagggggccagccggcgcuccuggccccucaacgagggcaucauggcgguggggcuggugagccugcucggcuccgcccugcugaagaacgacgucccgcucgccggccccaugguggccgggggccugcugcucgccgcguacgugaugagcggguccagcgccgaccugagccuggagaaggccgccaacguccagugggacgagauggccgacaucaccggcuccagccccaucaucgaggugaagcaggacgaggacggguccuucagcauccgggacguggaggagaccaacaugaucacccuccuggucaagcuggcgcucaucacgguguccggccuguacccccuggccaucccgaucaccaugacccucugguacauguggcaggugaagacccagcgcagcggcgcccugugggacguccccucccccgccgccacccagaaggcggcccugagcgaggggguguaccggaucaugcagcgcggccucuucgggaagacgcaggugggcgucgggauccacauggagggcguguuccacaccauguggcacgugacccggggcuccgucaucugccacgagaccgggcgccuggagcccagcugggccgacgugcgcaacgacaugaucuccuacggcgggggcuggcggcugggcgacaagugggacaaggaggaggacgugcagguccucgccaucgagccggggaagaaccccaagcacgugcagacgaagcccggccuguucaagacccugaccggggagaucggcgccgugacccucgacuucaagcccgggacgagcggcuccccgaucaucaaccgcaagggcaaggucaucgggcuguacggcaacgggguggugaccaagagcggcgacuacgucuccgcgaucacccaggccgagcggaucggggagcccgacuacgagguggacgaggacaucuuccgcaagaagcggcugaccaucauggaccuccaccccggcgccggcaagacgaagcgcauccugccgagcaucgugcgggaggcccugaagcgccggcugcgcacccucauccuggcgcccacccgggucguggccgccgagauggaggaggcccugcgcgggcuccccauccgguaccagacccccgccgugaaguccgagcacacgggccgcgagaucgucgaccugaugugccacgcgaccuucaccacccggcugcucagcuccacgcgcgugccgaacuacaaccugaucgugauggacgaggcccacuucaccgaccccagcagcgucgccgcccggggguacaucuccacccgcguggagaugggcgaggccgcggccaucuucaugaccgccacgccccccggggccaccgacccguucccccagagcaacucccccaucgaggacaucgagcgggagauccccgagcgcagcuggaacaccggcuucgacuggaucaccgacuaccagggcaagacggucugguucgugccguccaucaaggccgggaacgacaucgcgaacugccugcgcaagagcggcaagaaggugauccagcucucccggaagaccuucgacaccgaguaccccaagaccaagcugacggacugggacuucgucgugaccaccgacaucagcgagaugggggccaacuuccgcgccggccgggugaucgacccccgccggugccugaagcccgucauccucaccgacgggccggagcgcgugauccuggccggccccauccccgugacgcccgcguccgccgcccagcggcgcggccggaucgggcgcaaccuggcccaggaggacgaccaguacgucuucagcggcgacccgcucaagaacgacgaggaccacgcccacuggaccgaggcgaagaugcugcuggacaacaucuacacccccgaggggaucauccccacccucuucggccccgagcgggagaagacgcaggccaucgacggcgaguuccgccugcggggggagcagcgcaagaccuucguggagcugaugcggcgcggcgaccucccgguguggcuguccuacaaggucgccagcgccgggaucuccuacaaggaccgggaguggugcuucaccggcgagcgcaacaaccagauccuggaggagaacauggagguggagaucuggacccgggagggggagaagaagaagcuccgccccaaguggcuggacgcccggguguacgcggaccccauggcccugaaggacuucaaggaguucgccagcggccgcaaguccaucacccucgacauccugacggagaucgccagccugcccaccuaccucuccagccgcgccaagcuggcgcuggacaacaucgucaugcuccacaccaccgagcggggcgggcgcgccuaccagcacgcccugaacgagcugccggagucccucgagacgcugaugcugguggcccuccugggcgcgaugaccgccgggaucuuccuguucuucaugcagggcaaggggaucggcaagcucagcaugggccugaucaccaucgccguggccagcgggcugcucugggucgccgagauccagccccaguggaucgcggccuccaucauccuggaguucuuccugauggugcuccugauccccgagccggagaagcagcggaccccccaggacaaccagcugaucuacgugauccucacgauccugaccaucaucggccugaucgccgccaacgagauggggcucaucgagaagaccaagaccgacuucggcuucuaccaggucaagacggagaccaccauccuggacguggaccugcgccccgccagcgcguggacccucuacgccguggccacgaccauccugacccccaugcugcggcacaccaucgagaacacguccgccaaccucagccuggccgcgaucgccaaccaggccgccguccugauggggcucggcaagggcuggccgcugcaccgcauggaccugggggugccccuccuggccaugggcugcuacucccaggugaaccccaccacccugaccgcgagccucgucaugcugcuggugcacuacgccaucaucgggcccggccuccaggccaaggccacgcgggaggcgcagaagcgcaccgccgccggcaucaugaagaacccgaccguggacgggaucaccgucaucgaccuggagcccaucuccuacgaccccaaguucgagaagcagcugggccaggugaugcuccuggugcugugcgccgggcagcuccugcugaugcggacgaccugggccuucugcgagguccucacccuggcgaccggccccauccugacgcucugggaggggaacccgggccgcuucuggaacaccaccaucgccgugagcaccgccaacaucuuccggggcuccuaccuggccggggccggccuggcguucagccucaucaagaacgcccagacgccccgccgggggaccggcaccaccggggagacccugggcgagaaguggaagcgccagcugaacucccucgaccggaaggaguucgaggaguacaagcgcagcggcauccuggagguggaccggacggaggccaaguccgcccugaaggacgggagcaagaucaagcacgccgucucccgcggcagcuccaagauccgguggaucguggagcgcgggauggugaagcccaagggcaaggucguggaccucgggugcggccgcggcggguggagcuacuacauggcgacccugaagaacgugaccgaggucaagggcuacaccaaggggggccccgggcacgaggagccgauccccauggccacguacggcuggaaccuggugaagcuccacuccggcguggacgucuucuacaagcccaccgagcagguggacacccugcugugcgacaucggggagagcagcuccaaccccaccaucgaggagggccggacgcuccgcgugcugaagauggucgagccguggcugagcuccaagcccgaguucugcaucaaggugcugaaccccuacaugcccaccgugaucgaggagcucgagaagcugcagcggaagcacgggggcaaccugguccgcugcccgcucagccggaacuccacccacgagauguacugggugagcggcgccuccgggaacaucgucagcuccgugaacaccacgagcaagaugcugcugaaccgcuucaccacccggcaccgcaagcccaccuacgagaaggacguggaccucggcgccgggacgcgguccgucagcaccgagaccgagaagcccgacaugaccaucaucggccgccggcugcagcgccugcaggaggagcacaaggagacguggcacuacgaccaggagaaccccuaccggaccugggcguaccacggguccuacgaggccccgagcaccggcuccgccagcuccauggugaacggcguggucaagcuccugaccaagcccugggacgugauccccauggugacgcagcuggccaugaccgacaccaccccguucgggcagcagcgcgucuucaaggagaagguggacacgcggaccccccagcccaagcccggcacccgcauggugaugaccacgaccgccaacuggcucugggcgcugcuggggaagaagaagaacccgcggcucugcacccgcgaggaguucaucagcaagguccgguccaacgccgccaucggcgccguguuccaggaggagcagggguggaccagcgccagcgaggcggugaacgacucccgcuucugggagcuggucgacaaggagcgggcccugcaccaggagggcaagugcgagagcugcguguacaacaugaugggcaagcgcgagaagaagcucggggaguucggccgcgccaaggggucccgggccaucugguacauguggcugggcgcccgcuuccuggaguucgaggcgcucggguuccugaacgaggaccacugguucggccgggagaacagcugguccggcguggagggggagggccugcaccgccucggguacauccuggaggagaucgacaagaaggacggcgaccugauguacgccgacgacacggccggcugggacacccggaucaccgaggacgaccuccagaacgaggagcugaucaccgagcagauggccccccaccacaagauccuggcgaaggccaucuucaagcucaccuaccagaacaaggucgugaaggugcugcgccccacgccccggggggccgucauggacaucaucagccgcaaggaccagcggggcuccgggcaggugggcaccuacgggcugaacaccuucaccaacauggaggugcagcucauccgccagauggaggccgagggcgucaucacgcaggacgacaugcagaacccgaagggccugaaggagcggguggagaaguggcugcgcgagugcgggguggaccggcucaagcgcauggccaucagcggcgacgacugcgucgugaagccccuggacgagcgguucgggaccucccugcucuuccugaacgacaugggcaaggugcgcaaggacaucccccagugggagcccagcaagggguggaagaacuggcaggaggucccguucugcucccaccacuuccacaagaucuucaugaaggacggccggagccugguggugcccugccgcaaccaggacgagcucaucggccgggcgcgcaucucccagggggccggcuggagccugcgcgagaccgccugccuggggaaggccuacgcccagauguggucccucauguacuuccaccggcgcgaccugcggcuggcgagcauggccaucugcuccgccguccccaccgagugguuccccacgagccgcaccaccuggagcauccacgcccaccaccaguggaugaccacggaggacaugcucaagguguggaaccggguguggaucgaggacaacccgaacaugaucgacaagacccccguccacuccugggaggacauccccuaccugggcaagcgcgaggaccuguggugcgggagccucaucggccuguccagccgggccaccugggcgaagaacauccacaccgccaucacgcaggugcgcaaccugaucggcaaggaggaguacgccgacuacaugcccgugaugaagcgguacuccgccccgagcgaguccgaggggguccucuga

SEQ ID NO: 10473 - RNA, 9867 nt, Artificial Sequence
  derived and/or modified CDS sequence (opt1) from DENV-4__FJ882584__SS-prME
agcaccaucacccugcucugccugauccccacggugauggccuuccaccuguccacccgcgacggcgagccgcucaugaucgucgccaagcacgagcgggggcgcccccugcuguucaagaccaccgagggcaucaacaagugcacgcucaucgcgauggaccugggggagaugugcgaggacaccgugaccuacaagugcccccugcucgugaacaccgagcccgaggacaucgacugcuggugcaaccugacgagcaccugggucauguacggcaccugcacccaguccggggagcggcgccgggagaagcgcagcguggcccugacgccgcacuccggcaugggccucgagacccgggccgagaccuggaugagcuccgagggggccuggaagcacgcccagcgcguggagagcuggauccugcggaaccccggcuucgcgcugcucgccggguucauggccuacaugaucggccagaccgggauccagcgcacggucuucuucgugcugaugaugcugguggcccccuccuacggcaugcggugcgucggcguggggaaccgcgacuucguggagggcgucagcgggggcgcguggguggaccucgugcuggagcacggcgggugcgucaccaccauggcccagggcaagcccacccuggacuucgagcucacgaagaccaccgccaaggagguggcccugcugcggaccuacugcaucgaggccuccaucagcaacaucacgaccgcgacccgcugcccgacccagggggagcccuaccucaaggaggagcaggaccagcaguacaucugccggcgcgacguggucgaccggggcugggggaacggcugcggccuguucgggaagggcgggguggugacgugcgccaaguucuccugcagcggcaagaucaccgggaaccugguccagaucgagaaccucgaguacaccgugguggucaccgugcacaacggcgacacgcacgccgucggcaacgacaccuccaaccacggggugaccgccaccaucacgccccgcagccccuccguggaggucaagcugccggacuacggcgagcugacccucgacugcgagccccggagcgggaucgacuucaacgagaugauccugaugaagaugaagaagaagaccuggcuggugcacaagcagugguuccucgaccugccccugcccuggaccaccggcgccgacacguccgaggugcacuggaacuacaaggagcgcauggucaccuucaaggugccgcacgcgaagcggcaggacgugaccguccucgggagccaggagggcgccaugcacagcgcccuggccggcgccaccgagguggacuccggggacggcaaccacauguucgcggggcaccugaagugcaaggugcgcauggagaagcuccgcaucaagggcaugagcuacacgaugugcuccggcaaguucagcaucgacaaggagauggccgagacccagcacgggaccaccgucgugaaggugaaguacgagggcgccggggcccccugcaagguccccaucgagauccgggacgugaacaaggagaagguggucggccgcgugaucuccgccacgccccuggcggagaacaccaacagcgugaccaacaucgagcuggagccgcccuucggggacuccuacaucgucaucggcgugggcaacagcgcccucacccugcacugguuccggaagggguccagcaucggcaagauguucgaguccacguaccgcggggccaagcggauggccauccugggcgagaccgcgugggacuucgggagcgugggcggccucuucaccucccuggggaaggccguccaccagguguucggcagcguguacaccacgauguucgggggcgucuccuggaugauccgcauccugaucggguuccucgugcuguggaucggcaccaacagccggaacaccuccauggccaugaccugcaucgccgugggcgggaucacgcuguuccugggcuucaccguccaggccgacauggggugcguggugagcugguccggccgcgagcucaagugcgggagcggcaucuucgucguggacaacgugcacaccuggaccgagcaguacaaguuccagcccgagagccccgcgcggcuggccuccgccauccugaacgcccacaaggacggcgucugcgggauccgcagcacgacccggcucgagaacgugauguggaagcagaucaccaacgagcugaacuacgugcugugggagggcgggcacgaccucaccgucguggccggcgacgugaagggcguccugacgaaggggaagcgcgcgcugaccccgcccgccuccgaccucaaguacagcuggaagaccuggggcaaggccaagaucuucacccccgaggcccggaacuccacguuccugaucgacgggcccgacaccagcgagugcccgaacgagcgccgggccuggaacuccuucgagguggaggacuacggcuucgggauguucaccaccaacaucuggaugaaguuccgcgagggcagcuccgaggugugcgaccaccggcugaugagcgcggccaucaaggaccagaaggccguccacgccgacaugggcuacuggaucgaguccagcaagaaccagacguggcagaucgagcgcgcgucccucaucgaggugaagaccugccuguggcccaagacccacacccuguggagcaacggggugcucgagucccagaugcugauccccaagagcuacgccggcccguucucccagcacaacuaccggcagggguacgccacccagacggucggccccuggcaccuggggaagcucgagaucgacuucggcgagugccccggcaccaccgugaccauccaggagaacugcgaccaccgcgggcccagccugcgcacgaccaccgccagcggcaagcuggugacccaguggugcugccgguccugcacgaugccgccccuccgcuuccugggggaggacggcugcugguacgggauggagauccggccccugagcgagaaggaggagaacauggucaagucccaggugaccgccggccagggcaccagcgagaccuucuccauggggcuccugugccugacgcucuucgucgaggagugccugcgccggcgcgugacccggaagcacaugauccuggcgguggucaucacccucugcgccaucauccugggcgggcugaccuggauggaccuccugcgcgcccugaucaugcucggcgacacgaugagcggccggaucgggggccagacccaccuggccaucauggccguguucaagaugucccccggguacgugcugggcgucuuccuccgcaagcugaccagccgggagaccgcgcugauggugaucgggauggccaugacgaccacccucuccaucccgcacgaccugauggagcugaucgacggcaucagccucggccugauccugcucaagaucgugacccaguucgacaacacgcaggucgggacccuggcccugucccucaccuucauccgcagcaccaugucccuggugauggccuggcggacgaucauggccgugcuguucgucgugacccucaucccccugugccgcaccagcugccugcagaagcagucccacuggguggagaucaccgcgcucauccugggcgcccaggcccugcccgucuaccucaugacgcugaugaagggggccagccggcgcuccuggccccugaacgagggcaucauggcgguggggcucgugagccugcugggcuccgcccuccugaagaacgacgucccgcuggccggccccaugguggccgggggccuccugcuggccgcguacgugaugagcgggagcuccgccgaccucagccuggagaaggccgccaacguccagugggacgagauggccgacaucaccggcuccagccccaucaucgaggugaagcaggacgaggacggguccuucagcauccgggacguggaggagaccaacaugaucacccugcucgucaagcuggcgcugaucacgguguccggccucuacccccuggccaucccgaucaccaugacccugugguacauguggcaggugaagacccagcgcagcggcgcccucugggacguccccucccccgccgccacccagaaggcggcccugagcgaggggguguaccggaucaugcagcgcggccuguucgggaagacgcaggugggcgucgggauccacauggagggcguguuccacaccauguggcacgugacccggggcuccgucaucugccacgagaccgggcgccucgagcccagcugggccgacgugcgcaacgacaugaucuccuacggcgggggcuggcggcugggcgacaagugggacaaggaggaggacgugcagguccuggccaucgagccggggaagaaccccaagcacgugcagacgaagcccggccucuucaagacccugaccggggagaucggcgccgugacccuggacuucaagcccgggacgagcggcuccccgaucaucaaccgcaagggcaaggucaucgggcucuacggcaacgggguggugaccaagagcggcgacuacgucuccgcgaucacccaggccgagcggaucggggagcccgacuacgagguggacgaggacaucuuccgcaagaagcggcugaccaucauggaccugcaccccggcgccggcaagacgaagcgcauccucccgagcaucgugcgggaggcccugaagcgccggcugcgcacccugauccucgcgcccacccgggucguggccgccgagauggaggaggcccugcgcgggcugcccauccgguaccagacccccgccgugaaguccgagcacacgggccgcgagaucgucgaccucaugugccacgcgaccuucaccacccggcugcugagcagcacgcgcgugccgaacuacaaccucaucgugauggacgaggcccacuucaccgaccccuccagcgucgccgcccggggguacaucuccacccgcguggagaugggcgaggccgcggccaucuucaugaccgccacgccccccggggccaccgacccguucccccagagcaacucccccaucgaggacaucgagcgggagauccccgagcgcagcuggaacaccggcuucgacuggaucaccgacuaccagggcaagacggucugguucgugccguccaucaaggccgggaacgacaucgcgaacugccugcgcaagagcggcaagaaggugauccagcugucccggaagaccuucgacaccgaguaccccaagaccaagcucacggacugggacuucgucgugaccaccgacaucagcgagaugggggccaacuuccgcgccggccgggugaucgacccccgccggugccugaagcccgucauccugaccgacgggccggagcgcgugauccucgccggccccauccccgugacgcccgcguccgccgcccagcggcgcggccggaucgggcgcaacccggcccaggaggacgaccaguacgucuucagcggcgacccccugaagaacgacgaggaccacgcccacuggaccgaggcgaagaugcugcucgacaacaucuacacccccgaggggaucauccccacccuguucggcccggagcgggagaagacgcaggccaucgacggcgaguuccgccugcggggggagcagcgcaagaccuucguggagcucaugcggcgcggcgaccugcccguguggcuguccuacaaggucgccagcgccgggaucuccuacaaggaccgggaguggugcuucaccggcgagcgcaacaaccagauccucgaggagaacauggagguggagaucuggacccgggagggggagaagaagaagcugcgccccaaguggcuggacgcccggguguacgcggaccccauggcccucaaggacuucaaggaguucgccagcggccgcaaguccaucacccuggacauccugacggagaucgccagccucccgaccuaccuguccagccgcgccaagcuggcgcucgacaacaucgucaugcugcacaccaccgagcggggcgggcgcgccuaccagcacgcccugaacgagcuccccgagagccuggagacgcugaugcucguggcccugcugggcgcgaugaccgccgggaucuuccucuucuucaugcagggcaaggggaucggcaagcuguccaugggccugaucaccaucgccguggccagcgggcuccugugggucgccgagauccagccccaguggaucgcggccuccaucauccuggaguucuuccucauggugcugcugaucccggagcccgagaagcagcggaccccccaggacaaccagcucaucuacgugauccugacgauccugaccaucaucggccucaucgccgccaacgagauggggcugaucgagaagaccaagaccgacuucggcuucuaccaggucaagacggagaccaccauccuggacguggaccuccgccccgccagcgcguggacccuguacgccguggccacgaccauccugaccccgaugcuccggcacaccaucgagaacacguccgccaaccugagccuggccgcgaucgccaaccaggccgccguccucauggggcugggcaagggcuggccccugcaccgcauggaccucggggugccccugcuggccaugggcugcuacucccaggugaaccccaccacccucaccgcgagccuggucaugcugcucgugcacuacgccaucaucgggccgggccugcaggccaaggccacgcgggaggcgcagaagcgcaccgccgccggcaucaugaagaaccccaccguggacgggaucaccgucaucgaccuggagcccaucuccuacgaccccaaguucgagaagcagcucggccaggugaugcugcuggugcucugcgccgggcagcugcugcucaugcggacgaccugggccuucugcgagguccugacccuggcgaccggcccgauccucacgcugugggaggggaaccccggccgcuucuggaacaccaccaucgccgugagcaccgccaacaucuuccggggcuccuaccuggccggggccggccucgcguucagccugaucaagaacgcccagacgccccgccgggggaccggcaccaccggggagacccugggcgagaaguggaagcgccagcucaacucccuggaccggaaggaguucgaggaguacaagcgcagcggcauccuggagguggaccggacggaggccaaguccgcccucaaggacgggagcaagaucaagcacgccgucucccgcggcagcuccaagauccgguggaucguggagcgcgggauggugaagcccaagggcaaggucguggaccuggggugcggccgcggcggguggagcuacuacauggcgacccugaagaacgugaccgaggucaagggcuacaccaaggggggcccggggcacgaggagcccauccccauggccacguacggcuggaaccucgugaagcugcacagcggcguggacgucuucuacaagcccaccgagcagguggacacccugcucugcgacaucggggaguccagcuccaacccgaccaucgaggagggccggacgcugcgcgugcugaagauggucgagcccuggcucagcuccaagcccgaguucugcaucaaggugcugaaccccuacaugccgaccgugaucgaggagcuggagaagcugcagcggaagcacgggggcaaccucguccgcugcccccugagccggaacuccacccacgagauguacugggugagcggcgccuccgggaacaucgucagcuccgugaacaccacgagcaagaugcugcucaaccgcuucaccacccggcaccgcaagcccaccuacgagaaggacguggaccugggcgccgggacgcgguccgucagcaccgagaccgagaagcccgacaugaccaucaucggccgccggcugcagcgccuccaggaggagcacaaggagacguggcacuacgaccaggagaacccguaccggaccugggcguaccacggguccuacgaggcccccagcaccggcuccgccagcuccauggugaacggcguggucaagcugcugaccaagcccugggacgugaucccgauggugacgcagcucgccaugaccgacaccacccccuucgggcagcagcgcgucuucaaggagaagguggacacgcggaccccccagcccaagccgggcacccgcauggugaugaccacgaccgccaacuggcugugggcgcugcucgggaagaagaagaacccccggcugugcacccgcgaggaguucaucagcaagguccggagcaacgccgccaucggcgccguguuccaggaggagcagggguggaccuccgccagcgaggcggugaacgacucccgcuucugggagcuggucgacaaggagcgggcccuccaccaggagggcaagugcgagagcugcguguacaacaugaugggcaagcgcgagaagaagcugggggaguucggccgcgccaaggggucccgggccaucugguacauguggcugggcgcccgcuuccucgaguucgaggcgcugggguuccugaacgaggaccacugguucggccgggagaacagcugguccggcguggagggggagggccuccaccgccugggguacauccuggaggagaucgacaagaaggacggcgaccucauguacgccgacgacacggccggcugggacacccggaucaccgaggacgaccugcagaacgaggagcugaucaccgagcagauggccccccaccacaagauccucgcgaaggccaucuucaagcugaccuaccagaacaaggucgugaaggugcugcgccccacgccgcggggggccgucauggacaucaucagccgcaaggaccagcggggcuccgggcaggugggcaccuacgggcucaacaccuucaccaacauggaggugcagcugauccgccagauggaggccgagggcgucaucacgcaggacgacaugcagaaccccaagggccugaaggagcggguggagaaguggcuccgcgagugcgggguggaccggcugaagcgcauggccaucagcggcgacgacugcgucgugaagccccuggacgagcgguucgggaccucccuccuguuccugaacgacaugggcaaggugcgcaaggacaucccccagugggagccgagcaagggguggaagaacuggcaggagguccccuucugcucccaccacuuccacaagaucuucaugaaggacggccggagccucguggugcccugccgcaaccaggacgagcugaucggccgggcgcgcaucucccagggggccggcuggagccugcgcgagaccgccugccucgggaaggccuacgcccagauguggucccugauguacuuccaccggcgcgaccugcggcucgcgagcauggccaucugcagcgccguccccaccgagugguucccgacgucccgcaccaccuggagcauccacgcccaccaccaguggaugaccacggaggacaugcugaagguguggaaccggguguggaucgaggacaaccccaacaugaucgacaagacccccguccacuccugggaggacauccccuaccugggcaagcgcgaggaccucuggugcgggagccugaucggccuguccagccgggccaccugggcgaagaacauccacaccgccaucacgcaggugcgcaaccucaucggcaaggaggaguacguggacuacaugccggucaugaagcgguacuccgcccccagcgaguccgagggggugcuguga

SEQ ID NO: 10474 - RNA, 9867 nt, Artificial Sequence
  derived and/or modified CDS sequence (opt1) from DENV-4__FJ882585__SS-prME
agcaccaucacccugcucugccugauccccacggugauggccuuccaccuguccacccgcgacggcgagccgcucaugaucgucgccaagcacgagcgggggcgcccccugcuguucaagaccaccgagggcaucaacaagugcacgcucaucgcgauggaccugggggagaugugcgaggacaccgugaccuacaagugcccccugcucgugaacaccgagcccgaggacaucgacugcuggugcaaccugacgagcaccugggucauguacggcaccugcacccaguccggggagcggcgccgggagaagcgcagcguggcccugacgccgcacuccggcaugggccucgagacccgggccgagaccuggaugagcuccgagggggccuggaagcacgcccagcgcguggagagcuggauccugcggaaccccggcuucgcgcugcucgccggguucauggccuacaugaucggccagaccgggauccagcgcacggucuucuucgugcugaugaugcugguggcccccuccuacggcaugcggugcgucggcguggggaaccgcgacuucguggagggcgucagcgggggcgcguggguggaccucgugcuggagcacggcgggugcgucaccaccauggcccagggcaagcccacccuggacuucgagcucacgaagaccaccgccaaggagguggcccugcugcggaccuacugcaucgaggcccucaucuccaacaucacgaccgcgacccgcugcccgacccagggggagcccuaccugaaggaggagcaggaccagcaguacaucugccggcgcgacguggucgaccggggcugggggaacggcugcggccuguucgggaagggcgggguggugacgugcgccaaguucagcugcuccggcaagaucaccgggaaccucguccagaucgagaaccuggaguacaccgugguggucaccgugcacaacggcgacacgcacgccgucggcaacgacaccagcaaccacggggugaccgccaccaucacgccccgcucccccagcguggaggucaagcugccggacuacggcgagcucacccuggacugcgagccccgguccgggaucgacuucaacgagaugauccugaugaagaugaagaagaagaccuggcucgugcacaagcagugguuccuggaccugccccuccccuggaccaccggcgccgacacgagcgaggugcacuggaacuacaaggagcgcauggucaccuucaaggugccgcacgcgaagcggcaggacgugaccguccuggggucccaggagggcgccaugcacagcgcccuggccggcgccaccgagguggacagcggggacggcaaccacauguucgcggggcaccucaagugcaaggugcgcauggagaagcugcgcaucaagggcauguccuacacgaugugcagcggcaaguucuccaucgacaaggagauggccgagacccagcacgggaccaccgucgugaaggugaaguacgagggcgccggggcccccugcaagguccccaucgagauccgggacgugaacaaggagaagguggucggccgcgugaucagcgccacgccccuggcggagaacaccaacuccgugaccaacaucgagcucgagccgcccuucggggacagcuacaucgucaucggcgugggcaacuccgcccugacccugcacugguuccggaaggggagcuccaucggcaagauguucgagagcacguaccgcggggccaagcggauggccauccucggcgagaccgcgugggacuucggguccgugggcggccuguucaccagccuggggaaggccguccaccagguguucggcuccguguacaccacgauguucgggggcgucagcuggaugauccgcauccucaucggguuccuggugcuguggaucggcaccaacucccggaacaccagcauggccaugaccugcaucgccgugggcgggaucacgcuguuccucggcuucaccguccaggccgacauggggugcgugguguccuggagcggccgcgagcugaagugcggguccggcaucuucgucguggacaacgugcacaccuggaccgagcaguacaaguuccagcccgagagccccgcgcggcuggccagcgccauccucaacgcccacaaggacggcgucugcgggauccgcuccacgacccggcuggagaacgugauguggaagcagaucaccaacgagcugaacuacgugcucugggagggcgggcacgaccugaccgucguggccggcgacgugaagggcguccugacgaaggggaagcgcgcgcucaccccgcccgccagcgaccugaaguacuccuggaagaccuggggcaaggccaagaucuucacccccgaggcccggaacagcacguuccugaucgacgggcccgacaccuccgagugcccgaacgagcgccgggccuggaacagcuucgagguggaggacuacggcuucgggauguucaccaccaacaucuggaugaaguuccgcgagggcuccagcgaggugugcgaccaccggcucauguccgcggccaucaaggaccagaaggccguccacgccgacaugggcuacuggaucgagagcuccaagaaccagacguggcagaucgagcgcgcgagccugaucgaggugaagaccugccuguggcccaagacccacacccucugguccaacggggugcuggagagccagaugcugauccccaaguccuacgccggcccguucagccagcacaacuaccggcagggguacgccacccagacggucggccccuggcaccucgggaagcuggagaucgacuucggcgagugccccggcaccaccgugaccauccaggagaacugcgaccaccgcgggcccucccugcgcacgaccaccgccagcggcaagcucgugacccaguggugcugccggagcugcacgaugccgccccugcgcuuccugggggaggacggcugcugguacgggauggagauccggccccucuccgagaaggaggagaacauggucaagagccaggugaccgccggccagggcaccuccgagaccuucagcauggggcugcugugccucacgcuguucgucgaggagugccugcgccggcgcgugacccggaagcacaugauccucgcgguggucaucacccugugcgccaccauccugggcgggcucacguggauggaccugcugcgcgcccucaucaugcugggcgacaccauguccggccggaucgggggccagacccaccuggccaucauggccguguucaagaugagccccggguacgugcucggcgucuuccugcgcaagcugaccucccgggagacggcgcucauggugaucgggauggccaugaccaccacccugagcaucccgcacgaccugauggagcucaucgacggcaucucccugggccugauccuccugaagaucgugacgcaguucgacaacacccaggucgggacccuggcccucagccugaccuucauccgcuccacgaugagccuggugauggccuggcggaccaucauggccgugcucuucgucgugacccugaucccccugugccgcaccuccugccuccagaagcagagccacuggguggagaucacggcgcugauccugggcgcccaggcccuccccgucuaccugaugacccugaugaagggggccucccggcgcagcuggccccucaacgagggcaucauggcgguggggcuggugucccugcucggcagcgcccugcugaagaacgacgucccgcucgccggccccaugguggccgggggccugcugcucgccgcguacgugauguccgggagcagcgccgaccugucccuggagaaggccgccaacguccagugggacgagauggccgcgaucaccggcagcucccccaucaucgaggugaagcaggacgaggacgggagcuucuccauccgggacguggaggagaccaacaugaucacgcuccuggucaagcuggcccucaucaccgugagcggccuguacccccuggccaucccgaucaccaugacccucugguacauguggcaggugaagacccagcgcuccggcgcccugugggacguccccagccccgccgcgacgcagaaggccgcccuguccgaggggguguaccggaucaugcagcgcggccucuucgggaagacccaggugggcgucgggauccacauggagggcguguuccacaccauguggcacgugacccggggcagcgucaucugccacgagacggggcgccuggagcccuccugggccgacgugcgcaacgacaugaucagcuacggcgggggcuggcggcugggcgacaagugggacaaggaggaggacgugcagguccucgccaucgagccggggaagaaccccaagcacgugcagaccaagcccggccuguucaagacccugaccggggagaucggcgcggugacgcucgacuucaagcccgggaccuccggcagcccgaucaucaaccgcaagggcaaggucaucgggcuguacggcaacgggguggugaccaaguccggcgacuacgucagcgccaucacccaggccgagcggaucggggagcccgacuacgagguggacgaggacaucuuccgcaagaagcggcugacgaucauggaccuccaccccggcgccggcaagaccaagcgcauccugccguccaucgugcgggaggcgcugaagcgccggcugcgcacccucauccuggcccccacccgggucguggccgccgagauggaggaggcccugcgcgggcuccccauccgguaccagacgcccgcggugaagagcgagcacaccggccgcgagaucgucgaccugaugugccacgccaccuucaccacgcggcugcucuccagcacccgcgugccgaacuacaaccugaucgugauggacgaggcccacuucaccgaccccagcuccgucgccgcccggggguacaucagcacccgcguggagaugggcgaggcggccgccaucuucaugacggccaccccccccggggccaccgacccguucccccaguccaacagccccaucgaggacaucgagcgggagauccccgagcgcuccuggaacaccggcuucgacuggaucacggacuaccagggcaagaccgucugguucgugccgagcaucaaggcggggaacgacaucgccaacugccugcgcaaguccggcaagaaggugauccagcucagccggaagaccuucgacaccgaguaccccaagacgaagcugaccgacugggacuucgucgugaccaccgacaucuccgagaugggggccaacuuccgcgccggccgggugaucgacccccgccggugccugaagcccgucauccucacggacgggccggagcgcgugauccuggcgggccccauccccgugacccccgccagcgccgcccagcggcgcggccggaucgggcgcaacccggcccaggaggacgaccaguacgucuucuccggcgacccccugaagaacgacgaggaccacgcgcacuggaccgaggccaagaugcuccuggacaacaucuacacccccgaggggaucauccccacgcuguucggcccggagcgggagaagacccaggccaucgacggcgaguuccgccuccggggggagcagcgcaagaccuucguggagcugaugcggcgcggcgaccugcccguguggcucagcuacaaggucgccuccgccgggaucagcuacaaggaccgggaguggugcuucaccggcgagcgcaacaaccagauccuggaggagaacauggagguggagaucuggacccgggagggggagaagaagaagcugcgccccaaguggcucgacgcgcggguguacgccgaccccauggcccugaaggacuucaaggaguucgccuccggccgcaagagcacgacccuggacauccucaccgagaucgccucccugccgaccuaccugagcucccgcgcgaagcucgcccuggacaacaucgucaugcugcacacgaccgagcggggcgggcgcgccuaccagcacgcccucaacgagcugcccgagagccuggagacccucaugcugguggcgcugcucggcgccaugaccgccgggaucuuccuguucuucaugcagggcaaggggaucggcaagcugagcaugggccucaucacgaucgccguggccuccgggcugcugugggucgcggagauccagccccaguggaucgccgccagcaucauccucgaguucuuccugauggugcugcucaucccggagcccgagaagcagcggaccccccaggacaaccagcugaucuacgugauccugaccauccucaccaucaucggccugaucgccgccaacgagauggggcugaucgagaagacgaagaccgacuucggcuucuaccaggucaagaccgagaccacgauccucgacguggaccugcgccccgcguccgccuggacccuguacgccguggccaccaccauccucacgccgaugcugcggcacaccaucgagaacaccagcgccaaccugucccucgcggccaucgccaaccaggccgccguccugauggggcugggcaagggcuggccccuccaccgcauggaccugggggugccccugcucgcgaugggcugcuacagccaggugaaccccaccacgcugaccgccucccuggucaugcuccuggugcacuacgccaucaucgggccgggccugcaggccaaggcgacccgggaggcccagaagcgcaccgccgccggcaucaugaagaaccccacgguggacgggaucaccgucaucgaccucgagcccaucagcuacgaccccaaguucgagaagcagcugggccaggugaugcugcucgugcugugcgccgggcagcugcuccugaugcggaccaccugggcguucugcgagguccugacgcucgccaccggcccgauccugacccugugggaggggaaccccggccgcuucuggaacaccacgaucgccguguccaccgccaacaucuuccggggcagcuaccucgccggggcgggccuggccuucucccugaucaagaacgcccagaccccccgccgggggaccggcaccacgggggagacccucggcgagaaguggaagcgccagcugaacagccuggaccggaaggaguucgaggaguacaagcgcuccggcauccucgagguggaccggaccgaggccaagagcgcccugaaggacggguccaagaucaagcacgcggucagccgcggcuccagcaagauccgguggaucguggagcgcgggauggugaagcccaagggcaaggucguggaccuggggugcggccgcggcgggugguccuacuacauggccacccucaagaacgugacggaggucaagggcuacaccaaggggggcccggggcacgaggagcccauccccauggccaccuacggcuggaaccuggugaagcugcacagcggcguggacgucuucuacaagcccaccgagcagguggacacgcuccugugcgacaucggggagagcuccagcaacccgaccaucgaggagggccggacccugcgcgugcucaagauggucgagcccuggcuguccagcaagcccgaguucugcaucaaggugcugaaccccuacaugccgaccgugaucgaggagcuggagaagcuccagcggaagcacgggggcaaccugguccgcugcccccugucccggaacagcacgcacgagauguacuggguguccggcgccagcgggaacaucgucuccagcgugaacaccaccuccaagaugcuccugaaccgcuucaccacgcggcaccgcaagcccaccuacgagaaggacguggaccugggcgcggggacccggagcgucuccaccgagacggagaagcccgacaugaccaucaucggccgccggcuccagcgccugcaggaggagcacaaggagaccuggcacuacgaccaggagaacccguaccggaccugggccuaccacgggagcuacgaggcccccuccacgggcagcgccuccagcauggugaacggcguggucaagcugcucaccaagcccugggacgugaucccgauggugacccagcuggccaugaccgacacgacccccuucgggcagcagcgcgucuucaaggagaagguggacacccggaccccccagcccaagccgggcacgcgcauggugaugaccaccaccgcgaacuggcugugggcccuccuggggaagaagaagaacccccggcugugcacgaaggaggaguucaucuccaagguccgcagcaacgccgccaucggcgccguguuccaggaggagcagggguggaccagcgcguccgaggccgugaacgacagccgguucugggagcucgucgacaaggagcgcgcccugcaccaggagggcaagugcgaguccugcguguacaacaugaugggcaagcgggagaagaagcugggggaguucggccgcgccaaggggagccgcgccaucugguacauguggcucggcgcgcgguuccuggaguucgaggcccugggguuccucaacgaggaccacugguucggccgcgagaacuccuggagcggcguggagggggagggccugcaccggcugggguacauccucgaggagaucgacaagaaggacggcgaccugauguacgccgacgacaccgccggcugggacacccgcaucaccgaggacgaccugcagaacgaggagcucaucacggagcagauggcgccccaccacaagauccuggccaaggccaucuucaagcugaccuaccagaacaaggucgugaaggugcuccggcccaccccgcgcggggccgucauggacaucaucucccggaaggaccagcgcggcagcgggcaggugggcaccuacgggcugaacacguucaccaacauggaggugcagcugauccggcagauggaggccgagggcgucaucacccaggacgacaugcagaaccccaagggccucaaggagcgcguggagaaguggcugcgggagugcgggguggaccgccugaagcggauggcgaucuccggcgacgacugcgucgugaagccccucgacgagcgcuucgggaccagccugcuguuccucaacgacaugggcaaggugcggaaggacaucccccagugggagccguccaagggguggaagaacuggcaggagguccccuucugcagccaccacuuccacaagaucuucaugaaggacggccgcucccugguggugcccugccggaaccaggacgagcugaucggccgcgcccggaucagccagggggccggcuggucccuccgcgagacggccugccuggggaaggccuacgcgcagauguggagccugauguacuuccaccgccgggaccuccgccuggccuccauggccaucugcagcgccguccccaccgagugguucccgaccagccggaccacgugguccauccacgcccaccaccaguggaugaccaccgaggacaugcugaagguguggaaccgcguguggaucgaggacaaccccaacaugaccgacaagacgcccguccacagcugggaggacauccccuaccucggcaagcgggaggaccuguggugcgggucccugaucggccucagcucccgcgcgaccugggccaagaacauccacaccgccaucacccaggugcggaaccugaucggcaaggaggaguacguggacuacaugccggucaugaagcgcuacagcgcccccuccgagagcgagggggugcuguga

SEQ ID NO: 10475 - RNA, 9867 nt, Artificial Sequence
  derived and/or modified CDS sequence (opt1) from DENV-4__FJ882586__SS-prME
agcaccaucacccugcucugccugauccccacggugauggccuuccaccuguccacccgcgacggcgagccgcucaugaucgucgccaagcacgagcgggggcgcccccugcuguucaagaccaccgagggcaucaacaagugcacgcucaucgcgauggaccugggggagaugugcgaggacaccgugaccuacaagugcccccugcucgugaacaccgagcccgaggacaucgacugcuggugcaaccugacgagcaccugggucauguacggcaccugcacccaguccggggagcggcgccgggagaagcgcagcguggcccugacgccgcacuccggcaugggccucgagacccgggccgagaccuggaugagcuccgagggggccuggaagcacgcccagcgcguggagagcuggauccugcggaaccccggcuucgcgcugcucgccggguucauggccuacaugaucggccagaccgggauccagcgcacggucuucuucgugcugaugaugcugguggcccccuccuacggcaugcggugcgucggcguggggaaccgcgacuucguggagggcgucagcgggggcgcguggguggaccucgugcuggagcacggcgggugcgucaccaccauggcccagggcaagcccacccuggacuucgagcucacgaagaccaccgccaaggagguggcccugcugcggaccuacugcaucgaggcccucaucuccaacaucacgaccgcgacccgcugcccgacccagggggagcccuaccugaaggaggagcaggaccagcaguacaucugccggcgcgacguggucgaccggggcugggggaacggcugcggccuguucgggaagggcgggguggugacgugcgccaaguucagcugcuccggcaagaucaccgggaaccucguccagaucgagaaccuggaguacaccgugguggucaccgugcacaacggcgacacgcacgccgucggcaacgacaccagcaaccacggggugaccgccaccaucacgccccgcucccccagcguggaggucaagcugccggacuacggcgagcucacccuggacugcgagccccgguccgggaucgacuucaacgagaugauccugaugaagaugaagaagaagaccuggcucgugcacaagcagugguuccuggaccugccccuccccuggaccaccggcgccgacacgagcgaggugcacuggaacuacaaggagcgcauggucaccuucaaggugccgcacgcgaagcggcaggacgugaccguccuggggucccaggagggcgccaugcacagcgcccuggccggcgccaccgagguggacagcggggacggcaaccacauguucgcggggcaccucaagugcaaggugcgcauggagaagcugcgcaucaagggcauguccuacacgaugugcagcggcaaguucuccaucgacaaggagauggccgagacccagcacgggaccaccgucgugaaggugaaguacgagggcgccggggcccccugcaagguccccaucgagauccgggacgugaacaaggagaagguggucggccgcgugaucagcgccacgccccuggcggagaacaccaacuccgugaccaacaucgagcucgagccgcccuucggggacagcuacaucgucaucggcgugggcaacuccgcccugacccugcacugguuccggaaggggagcuccaucggcaagauguucgagagcacguaccgcggggccaagcggauggccauccucggcgagaccgcgugggacuucggguccgugggcggccuguucaccagccuggggaaggccguccaccagguguucggcuccguguacaccacgauguucgggggcgucagcuggaugauccgcauccucaucggguuccuggugcuguggaucggcaccaacucccggaacaccagcauggccaugaccugcaucgccgugggcgggaucacgcuguuccucggcuucaccguccaggccgacauggggugcgugguguccuggagcggccgcgagcugaagugcggguccggcaucuucgucguggacaacgugcacaccuggaccgagcaguacaaguuccagcccgagagccccgcgcggcuggccagcgccauccucaacgcccacaaggacggcgucugcgggauccgcuccacgacccggcuggagaacgugauguggaagcagaucaccaacgagcugaacuacgugcucugggagggcgggcacgaccugaccgucguggccggcgacgugaagggcguccugacgaaggggaagcgcgcgcucaccccgcccgccagcgaccugaaguacuccuggaagaccuggggcaaggccaagaucuucacccccgaggcccggaacagcacguuccugaucgacgggcccgacaccuccgagugcccgaacgagcgccgggccuggaacagcuucgagguggaggacuacggcuucgggauguucaccaccaacaucuggaugaaguuccgcgagggcuccagcgaggugugcgaccaccggcucauguccgcggccaucaaggaccagaaggccguccacgccgacaugggcuacuggaucgagagcuccaagaaccagacguggcagaucgagcgcgcgagccugaucgaggugaagaccugccuguggcccaagacccacacccucugguccaacggggugcuggagagccagaugcugauccccaaguccuacgccggcccguucagccagcacaacuaccggcagggguacgccacccagacggucggccccuggcaccucgggaagcuggagaucgacuucggcgagugccccggcaccaccgugaccauccaggagaacugcgaccaccgcgggcccucccugcgcacgaccaccgccagcggcaagcucgugacccaguggugcugccggagcugcacgaugccgccccugcgcuuccugggggaggacggcugcugguacgggauggagauccggccccucuccgagaaggaggagaacauggucaagagccaggugaccgccggccagggcaccuccgagaccuucagcauggggcugcugugccucacgcuguucgucgaggagugccugcgccggcgcgugacccggaagcacaugauccucgcgguggucaucacccugugcgccaucauccugggcgggcucaccuggauggaccugcugcgcgcccucaucaugcugggcgacacgauguccggccggaucgggggccagacccaccuggccaucauggccguguucaagaugagccccggguacgugcucggcgucuuccugcgcaagcugaccucccgggagaccgcgcucauggugaucgggauggccaugacgaccacccugagcaucccgcacgaccugauggagcucaucgacggcaucucccugggccugauccuccugaagaucgugacccaguucgacaacacgcaggucgggacccuggcccucagccugaccuucauccgcuccaccaugagccuggugauggccuggcggacgaucauggccgugcucuucgucgugacccugaucccccugugccgcaccuccugccuccagaagcagagccacuggguggagaucaccgcgcugauccugggcgcccaggcccuccccgucuaccugaugacgcugaugaagggggccucccggcgcagcuggccccucaacgagggcaucauggcgguggggcuggugucccugcucggcagcgcccugcugaagaacgacgucccgcucgccggccccaugguggccgggggccugcugcucgccgcguacgugauguccgggagcagcgccgaccugucccuggagaaggccgccaacguccagugggacgagauggccgacaucaccggcagcucccccaucaucgaggugaagcaggacgaggacgggagcuucuccauccgggacguggaggagaccaacaugaucacccuccuggucaagcuggcgcucaucacggugagcggccuguacccccuggccaucccgaucaccaugacccucugguacauguggcaggugaagacccagcgcuccggcgcccugugggacguccccagccccgccgccacccagaaggcggcccuguccgaggggguguaccggaucaugcagcgcggccucuucgggaagacgcaggugggcgucgggauccacauggagggcguguuccacaccauguggcacgugacccggggcagcgucaucugccacgagaccgggcgccuggagcccuccugggccgacgugcgcaacgacaugaucagcuacggcgggggcuggcggcugggcgacaagugggacaaggaggaggacgugcagguccucgccaucgagccggggaagaaccccaagcacgugcagacgaagcccggccuguucaagacccugaccggggagaucggcgccgugacccucgacuucaagcccgggacguccggcagcccgaucaucaaccgcaagggcaaggucaucgggcuguacggcaacgggguggugaccaaguccggcgacuacgucagcgcgaucacccaggccgagcggaucggggagcccgacuacgagguggacgaggacaucuuccgcaagaagcggcugaccaucauggaccuccaccccggcgccggcaagacgaagcgcauccugccguccaucgugcgggaggcccugaagcgccggcugcgcacccucauccuggcgcccacccgggucguggccgccgagauggaggaggcccugcgcgggcuccccauccgguaccagacccccgccgugaagagcgagcacacgggccgcgagaucgucgaccugaugugccacgcgaccuucaccacccggcugcucuccagcacgcgcgugccgaacuacaaccugaucgugauggacgaggcccacuucaccgaccccagcuccgucgccgcccggggguacaucagcacccgcguggagaugggcgaggccgcggccaucuucaugaccgccacgccccccggggccaccgacccguucccccaguccaacagccccaucgaggacaucgagcgggagauccccgagcgcuccuggaacaccggcuucgacuggaucaccgacuaccagggcaagacggucugguucgugccgagcaucaaggccgggaacgacaucgcgaacugccugcgcaaguccggcaagaaggugauccagcucagccggaagaccuucgacaccgaguaccccaagaccaagcugacggacugggacuucgucgugaccaccgacaucuccgagaugggggccaacuuccgcgccggccgggugaucgacccccgccggugccugaagcccgucauccucaccgacgggccggagcgcgugauccuggccggccccauccccgugacgcccgcgagcgccgcccagcggcgcggccggaucgggcgcaacccggcccaggaggacgaccaguacgucuucuccggcgacccccugaagaacgacgaggaccacgcccacuggaccgaggcgaagaugcuccuggacaacaucuacacccccgaggggaucauccccacccuguucggcccggagcgggagaagacgcaggccaucgacggcgaguuccgccuccggggggagcagcgcaagaccuucguggagcugaugcggcgcggcgaccugcccguguggcucagcuacaaggucgccuccgccgggaucagcuacaaggaccgggaguggugcuucaccggcgagcgcaacaaccagauccuggaggagaacauggagguggagaucuggacccgggagggggagaagaagaagcugcgccccaaguggcucgacgcccggguguacgcggaccccauggcccugaaggacuucaaggaguucgccuccggccgcaagagcaucacccuggacauccucacggagaucgccucccugccgaccuaccugagcucccgcgccaagcucgcgcuggacaacaucgucaugcugcacaccaccgagcggggcgggcgcgccuaccagcacgcccucaacgagcugcccgagagccuggagacgcucaugcugguggcccugcucggcgcgaugaccgccgggaucuuccuguucuucaugcagggcaaggggaucggcaagcugagcaugggccucaucaccaucgccguggccuccgggcugcugugggucgccgagauccagccccaguggaucgcggccagcaucauccucgaguucuuccugauggugcugcucaucccggagcccgagaagcagcggaccccccaggacaaccagcugaucuacgugauccugacgauccucaccaucaucggccugaucgccgccaacgagauggggcugaucgagaagaccaagaccgacuucggcuucuaccaggucaagacggagaccaccauccucgacguggaccugcgccccgccuccgcguggacccuguacgccguggccacgaccauccucaccccgaugcugcggcacaccaucgagaacacgagcgccaaccugucccucgccgcgaucgccaaccaggccgccguccugauggggcugggcaagggcuggccccuccaccgcauggaccugggggugccccugcucgccaugggcugcuacagccaggugaaccccaccacccugaccgcgucccuggucaugcuccuggugcacuacgccaucaucgggccgggccugcaggccaaggccacgcgggaggcgcagaagcgcaccgccgccggcaucaugaagaaccccaccguggacgggaucaccgucaucgaccucgagcccaucagcuacgaccccaaguucgagaagcagcugggccaggugaugcugcucgugcugugcgccgggcagcugcuccugaugcggacgaccugggccuucugcgagguccugacccucgcgaccggcccgauccugacgcugugggaggggaaccccggccgcuucuggaacaccaccaucgccguguccaccgccaacaucuuccggggcagcuaccucgccggggccggccuggcguucucccugaucaagaacgcccagacgccccgccgggggaccggcaccaccggggagacccucggcgagaaguggaagcgccagcugaacagccuggaccggaaggaguucgaggaguacaagcgcuccggcauccucgagguggaccggacggaggccaagagcgcccugaaggacggguccaagaucaagcacgccgucagccgcggcuccagcaagauccgguggaucguggagcgcgggauggugaagcccaagggcaaggucguggaccuggggugcggccgcggcgggugguccuacuacauggcgacccucaagaacgugaccgaggucaagggcuacaccaaggggggcccggggcacgaggagcccauccccauggccacguacggcuggaaccuggugaagcugcacagcggcguggacgucuucuacaagcccaccgagcagguggacacccuccugugcgacaucggggagagcuccagcaacccgaccaucgaggagggccggacgcugcgcgugcucaagauggucgagcccuggcuguccagcaagcccgaguucugcaucaaggugcugaaccccuacaugccgaccgugaucgaggagcuggagaagcuccagcggaagcacgggggcaaccugguccgcugcccccugucccggaacagcacccacgagauguacuggguguccggcgccagcgggaacaucgucuccagcgugaacaccacguccaagaugcuccugaaccgcuucaccacccggcaccgcaagcccaccuacgagaaggacguggaccugggcgccgggacgcggagcgucuccaccgagaccgagaagcccgacaugaccaucaucggccgccggcuccagcgccugcaggaggagcacaaggagacguggcacuacgaccaggagaacccguaccggaccugggcguaccacgggagcuacgaggcccccuccaccggcagcgccuccagcauggugaacggcguggucaagcugcucaccaagcccugggacgugaucccgauggugacgcagcuggccaugaccgacaccacccccuucgggcagcagcgcgucuucaaggagaagguggacacgcggaccccccagcccaagccgggcacccgcauggugaugaccacgaccgccaacuggcugugggcgcuccuggggaagaagaagaacccccggcugugcacccgcgaggaguucaucuccaagguccggagcaacgccgccaucggcgccguguuccaggaggagcagggguggaccagcgccuccgaggcggugaacgacagccgcuucugggagcucgucgacaaggagcgggcccugcaccaggagggcaagugcgaguccugcguguacaacaugaugggcaagcgcgagaagaagcugggggaguucggccgcgccaaggggagccgggccaucugguacauguggcucggcgcccgcuuccuggaguucgaggcgcugggguuccucaacgaggaccacugguucggccgggagaacuccuggagcggcguggagggggagggccugcaccgccugggguacauccucgaggagaucgacaagaaggacggcgaccugauguacgccgacgacacggccggcugggacacccggaucaccgaggacgaccugcagaacgaggagcucaucaccgagcagauggccccccaccacaagauccuggcgaaggccaucuucaagcugaccuaccagaacaaggucgugaaggugcuccgccccacgccgcggggggccgucauggacaucaucucccgcaaggaccagcggggcagcgggcaggugggcaccuacgggcugaacaccuucaccaacauggaggugcagcugauccgccagauggaggccgagggcgucaucacgcaggacgacaugcagaaccccaagggccucaaggagcggguggagaaguggcugcgcgagugcgggguggaccggcugaagcgcauggccaucuccggcgacgacugcgucgugaagccccucgacgagcgguucgggaccagccugcuguuccucaacgacaugggcaaggugcgcaaggacaucccccagugggagccguccaagggguggaagaacuggcaggagguccccuucugcagccaccacuuccacaagaucuucaugaaggacggccggucccugguggugcccugccgcaaccaggacgagcugaucggccgggcgcgcaucagccagggggccggcuggucccuccgcgagaccgccugccuggggaaggccuacgcccagauguggagccugauguacuuccaccggcgcgaccuccggcuggcguccauggccaucugcagcgccguccccaccgagugguucccgacgagccgcaccaccugguccauccacgcccaccaccaguggaugaccacggaggacaugcugaagguguggaaccggguguggaucgaggacaaccccaacaugaucgacaagacccccguccacagcugggaggacauccccuaccucggcaagcgcgaggaccuguggugcgggucccugaucggccucagcucccgggccaccugggcgaagaacauccacaccgccaucgcccaggugcgcaaccugaucggcaaggaggaguacguggacuacaugccggucaugaagcgguacagcgcccccuccgagagcgagggggugcuguga

SEQ ID NO: 10476 - RNA, 9867 nt, Artificial Sequence
  derived and/or modified CDS sequence (opt1) from DENV-4__JN819406__SS-prME
agcaccaucacccugcucugccugauccccacggugauggccuuccaccuguccacccgcgacggcgagccccucaugaucguggccaagcacgagcgggggcgcccccugcuguucaagaccaccgagggcaucaacaagugcacgcucaucgcgauggaccugggggagaugugcgaggacaccgugaccuacaagugcccccugcucgugaacaccgagcccgaggacaucgacugcuggugcaaccugacgagcaccugggugauguacgggaccugcacccaguccggggagcggcgccgggagaagcgcagcguggcccugacgccgcacuccggcaugggccucgagacccgggccgagaccuggaugagcuccgagggggccuggaagcacgcccagcgcguggagagcuggauccugcggaaccccggcuucgcgcugcucgccggguucauggccuacaugaucggccagaccgggauccagcgcacgguguucuucgugcugaugaugcugguggcccccuccuacggcaugcggugcgucggcguggggaaccgcgacuucguggagggcgucagcgggggcgcguggguggaccucgugcuggagcacggcgggugcgucaccaccauggcccagggcaagcccacccuggacuucgagcucacgaagaccaccgccaaggagguggcccugcugcggaccuacugcaucgaggcccucaucuccaacaucacgaccgcgacccgcugcccgacccagggggagcccuaccugaaggaggagcaggaccagcaguacaucugccggcgcgacguggucgaccggggcugggggaacggcugcggccuguucgggaagggcgggguggugacgugcgccaaguucagcugcuccggcaagaucaccgggaaccucguccagaucgagaaccuggaguacaccgugguggucaccgugcacaacggcgacacgcacgccgucggcaacgacaccagcaaccacggggugaccgccaccaucacgccccgcucccccagcguggaggucaagcugccggacuacggcgagcucacccuggacugcgagccccgguccgggaucgacuucaacgagaugauccugaugaagaugaagaagaagaccuggcucgugcacaagcagugguuccuggaccugccccuccccuggaccaccggcgccgacacgagcgaggugcacuggaacuacaaggagcgcauggucaccuucaaggugccgcacgcgaagcggcaggacgugaccguccuggggucccaggagggcgccaugcacagcgcccuggccggcgccaccgagguggacagcggggacggcaaccacauguucgcggggcaccucaagugcaaggugcgcauggagaagcugcgcaucaagggcauguccuacacgaugugcagcggcaaguucuccaucgacaaggagauggccgagacccagcacgggaccaccgucgugaaggugaaguacgagggcgccggggcccccugcaagguccccaucgagauccgggacgugaacaaggagaagguggucggccgcgugaucagcgccacgccccuggcggagaacaccaacuccgugaccaacaucgagcucgagccgcccuucggggacagcuacaucgucaucggcgugggcaacuccgcccugacccugcacugguuccggaaggggagcuccaucggcaagauguucgagagcacguaccgcggggccaagcggauggccauccucggcgagaccgcgugggacuucggguccgugggcggccuguucaccagccuggggaaggccguccaccagguguucggcuccguguacaccacgauguucgggggcgucagcuggaugauccgcauccucaucggguuccuggugcuguggaucggcaccaacucccggaacaccagcauggccaugaccugcaucgccgugggcgggaucacgcuguuccucggcuucaccguccaggccgacauggggugcgugguguccuggagcgcgcgcgagcugaagugcggcuccgggaucuucgucguggacaacgugcacaccuggaccgagcaguaccaguuccagcccgagagccccgcccggcuggccagcgccauccucaacgcccacaaggacggcgucugcggcauccgcuccacgacccggcuggagaacgugauguggaagcagaucaccaacgagcugaacuacgugcucugggagggcgggcacgaccugaccgucguggcgggggacgugaagggcguccugacgaagggcaagcgcgcccucaccccgcccgccagcgaccugaaguacuccuggaagaccugggggaaggccaagaucuucacccccgaggcccggaacagcacguuccugaucgacggccccgacaccuccgagugcccgaacgagcgccgggcguggaacagcuucgagguggaggacuacggguucggcauguucaccaccaacaucuggaugaaguuccgcgagggguccagcgaggugugcgaccaccggcucauguccgccgccaucaaggaccagaaggccguccacgcggacaugggcuacuggaucgagagcuccaagaaccagacguggcagaucgagcgcgccagccugaucgaggugaagaccugccuguggcccaagacccacacccucugguccaacggcgugcuggagagccagaugcugauccccaaguccuacgccgggccguucagccagcacaacuaccggcagggcuacgccacccagacggucgggcccuggcaccucggcaagcuggagaucgacuucggggagugccccggcaccaccgugaccauccaggagaacugcgaccaccgcggccccucccugcgcacgaccaccgccagcgggaagcucgugacccaguggugcugccggagcugcacgaugccgccccugcgcuuccugggcgaggacgggugcugguacggcauggagauccggccccucuccgagaaggaggagaacauggucaagagccaggugaccgcggggcagggcaccuccgagaccuucagcaugggccugcugugccucacgcuguucgucgaggagugccugcgccggcgcgugacccggaagcacaugauccucgccguggucaucacccugugcgccaucauccucggcgggcucaccuggauggaccugcugcgcgcccucaucaugcugggggacacgauguccgggcggaucggcgggcagacccaccuggccaucauggcgguguucaagaugagccccggcuacgugcucggggucuuccugcgcaagcugaccucccgggagaccgcccucauggugaucggcauggccaugacgaccacccugagcaucccgcacgaccugauggagcucaucgacgggaucucccugggccugauccuccugaagaucgugacccaguucgacaacacgcaggucggcacccuggcccucagccugaccuucauccgcuccaccaugagccuggugauggccuggcggacgaucauggcggugcuguucgucgugacccugaucccccugugccgcaccuccugccuccagaagcagagccacuggguggagaucaccgcccugauccugggggcccaggcccuccccgucuaccugaugacgcugaugaagggcgcgucccggcgcagcuggccccucaacgaggggaucauggccgugggccuggugucccugcucgggagcgcccugcugaagaacgacgucccgcucgccggccccaugguggccggcgggcugcugcucgcggccuacgugauguccggcagcagcgccgaccugucccuggagaaggccgccaacguccagugggacgagauggcggacaucaccgggagcucccccaucaucgaggugaagcaggacgaggacggcagcuucuccauccgggacguggaggagaccaacaugaucacccuccuggucaagcuggcccucaucacggugagcgggcuguacccccuggccaucccgaucaccaugacccucugguacauguggcaggucaagacccagcgcuccggcgcccugugggacguccccagccccgccgcgacccagaaggccgcccuguccgagggcguguaccggaucaugcagcgcggccucuucggcaagacccaggugggggucggcauccacauggaggggguguuccacaccauguggcacgugacccggggcagcgucaucugccacgagaccggccgccuggagcccuccugggccgacgugcgcaacgacaugaucagcuacgggggcggguggcggcugggcgacaagugggacaaggaggaggacgugcagguccucgccaucgagccgggcaagaaccccaagcacgugcagacgaagcccgggcuguucaagacccugaccggcgagaucggggcggugacccucgacuucaagcccggcacguccgggagcccgaucaucaaccgcaagggcaaggucaucggccuguacgggaacggcguggugaccaaguccggggacuacgucagcgccaucacccaggccgagcggaucggcgagcccgacuacgagguggacgaggacaucuuccgcaagaagcggcugaccaucauggaccuccaccccggggccggcaagacgaagcgcauccugccguccaucgugcgggaggcgcugaagcgccggcugcgcacccucauccuggcccccacccgggucguggccgccgagauggaggaggcccugcgcggccuccccauccgguaccagacccccgcggucaagagcgagcacacggggcgcgagaucgucgaccugaugugccacgccaccuucaccacccggcugcucuccagcacgcgcgugccgaacuacaaccugaucgugauggacgaggcccacuucaccgaccccagcuccgucgccgcccggggcuacaucagcacccgcguggagaugggggaggcggccgccaucuucaugaccgccacgccgcccggcgccaccgacccguucccccaguccaacagccccaucgaggacaucgagcgggagauccccgagcgcuccuggaacaccggguucgacuggaucaccgacuaccagggcaagacggucugguucgugccgagcaucaaggcgggcaacgacaucgccaacugccugcgcaaguccgggaagaaggugauccagcucagccggaagaccuucgacaccgaguaccccaagaccaagcugacggacugggacuucgucgugaccaccgacaucuccgagaugggcgccaacuuccgcgccgggcgggugaucgacccccgccggugccugaagcccgucauccucaccgacggcccggagcgcgugauccuggcggggcccauccccgugacgcccgccagcgccgcccagcggcgcggccggaucggccgcaacccggcccaggaggacgaccaguacgucuucuccggggacccccugaagaacgacgaggaccacgcgcacuggaccgaggccaagaugcuccuggacaacaucuacacccccgagggcaucauccccacccuguucgggccggagcgggagaagacgcaggccaucgacggcgaguuccgccuccggggcgagcagcgcaagaccuucguggagcugaugcggcgcggggaccugcccguguggcucagcuacaaggucgccuccgccggcaucagcuacaaggaccgggaguggugcuucaccggggagcgcaacaaccagauccuggaggagaacauggagguggagaucuggacccgggagggcgagaagaagaagcugcgccccaaguggcucgacgcgcggguguacgccgaccccauggcccugaaggacuucaaggaguucgccuccgggcgcaagagcaucacccuggacauccucacggagaucgccucccugccgaccuaccugagcucccgcgcgaagcucgcccuggacaacaucgucaugcugcacaccaccgagcggggcggccgcgccuaccagcacgcccucaacgagcugcccgagagccuggagacgcucaugcugguggcgcugcucggggccaugaccgccggcaucuuccuguucuucaugcaggggaagggcaucgggaagcugagcaugggccucaucaccaucgccguggccuccggccugcugugggucgcggagauccagccccaguggaucgccgccagcaucauccucgaguucuuccugauggugcugcucaucccggagcccgagaagcagcggacgccccaggacaaccagcugaucuacgugauccugacgauccucaccaucaucgggcugaucgccgccaacgagaugggccugaucgagaagaccaagaccgacuucggguucuaccaggucaagacggagaccaccauccucgacguggaccugcgccccgcguccgccuggacccuguacgccguggccacgaccauccucaccccgaugcugcggcacaccaucgagaacacgagcgccaaccugucccucgcggccaucgccaaccaggccgccguccugaugggccuggggaagggcuggccccuccaccgcauggaccugggcgugccccugcucgcgauggggugcuacagccaggugaaccccaccacccugaccgccucccuggucaugcuccuggugcacuacgccaucaucggcccggggcugcaggccaaggcgacgcgggaggcccagaagcgcaccgccgccggcaucaugaagaaccccaccguggacggcaucaccgucaucgaccucgagcccaucagcuacgaccccaaguucgagaagcagcugggccaggugaugcugcucgugcugugcgccggccagcugcuccugaugcggacgaccugggcguucugcgagguccugacccucgccaccgggccgauccugacgcugugggagggcaaccccgggcgcuucuggaacaccaccaucgccguguccaccgccaacaucuuccggggcagcuaccucgccggcgcggggcuggccuucucccugaucaagaacgcccagacgccccgccggggcaccgggaccaccggcgagacccucggggagaaguggaagcgccagcugaacagccuggaccggaaggaguucgaggaguacaagcgcuccggcauccucgagguggaccggacggaggccaagagcgcccugaaggacggcuccaagaucaagcacgcggucagccgcggguccagcaagauccgguggaucguggagcgcggcauggugaagcccaaggggaaggucguggaccugggcugcgggcgcggcggcugguccuacuacauggccacccucaagaacgugaccgaggucaagggguacaccaagggcgggccgggccacgaggagcccauccccauggccacguacggguggaaccuggugaagcugcacagcggcguggacgucuucuacaagcccaccgagcaggucgacacccuccugugcgacaucggcgagagcuccagcaacccgaccaucgaggaggggcggacgcugcgcgugcucaagauggucgagcccuggcuguccagcaagcccgaguucugcaucaaggugcugaaccccuacaugccgaccgugaucgaggagcuggagaagcuccagcggaagcacggcgggaaccugguccgcugcccccugucccggaacagcacccacgagauguacuggguguccggcgccagcggcaacaucgucuccagcgugaacaccacguccaagaugcuccugaaccgcuucaccacccggcaccgcaagcccaccuacgagaaggacguggaccugggggcgggcacgcggagcgucuccaccgagaccgagaagcccgacaugaccaucaucgggcgccggcuccagcgccugcaggaggagcacaaggagacguggcacuacgaccaggagaacccguaccggaccugggccuaccacggcagcuacgaggcccccuccaccgggagcgccuccagcauggugaacggcguggucaagcugcucaccaagcccugggacgugaucccgauggugacgcagcuggccaugaccgacaccacccccuucggccagcagcgcgucuucaaggagaagguggacacgcggacgccccagcccaagccggggacccgcauggugaugaccacgaccgcgaacuggcugugggcccuccugggcaagaagaagaacccccggcugugcacccgcgaggaguucaucuccaagguccggagcaacgccgccaucggggccguguuccaggaggagcagggcuggaccagcgcguccgaggccgugaacgacagccgcuucugggagcucgucgacaaggagcgggcccugcaccaggaggggaagugcgaguccugcguguacaacaugaugggcaagcgcgagaagaagcugggcgaguucgggcgcgccaagggcagccgggccaucugguacauguggcucggggcgcgcuuccuggaguucgaggcccugggcuuccucaacgaggaccacugguucgggcgggagaacuccuggagcggcguggagggcgaggggcugcaccgccugggcuacauccucgaggagaucgacaagaaggacggggaccugauguacgccgacgacacggccggcugggacacccggaucaccgaggacgaccugcagaacgaggagcucaucaccgagcagauggcgccccaccacaagauccuggccaaggccaucuucaagcugaccuaccagaacaaggucgugaaggugcuccgccccacgccgcggggcgccgucauggacaucaucucccgcaaggaccagcgggggagcggccagguggggaccuacggccugaacaccuucaccaacauggaggugcagcugauccgccagauggaggccgagggggucaucacgcaggacgacaugcagaaccccaagggccucaaggagcggguggagaaguggcugcgcgagugcggcguggaccggcugaagcgcauggcgaucuccggggacgacugcgucgugaagccccucgacgagcgguucggcaccagccugcuguuccucaacgacauggggaaggugcgcaaggacaucccccagugggagccguccaagggcuggaagaacuggcaggagguccccuucugcagccaccacuuccacaagaucuucaugaaggacgggcggucccugguggugcccugccgcaaccaggacgagcugaucggccgggcccgcaucagccagggcgccggguggucccuccgcgagaccgccugccugggcaaggccuacgcgcagauguggagccugauguacuuccaccggcgcgaccuccggcuggccuccauggccaucugcagcgccguccccaccgagugguucccgacgagccgcaccaccugguccauccacgcccaccaccaguggaugaccacggaggacaugcugaagguguggaaccggguguggaucgaggacaaccccaacaugaucgacaagacccccguccacagcugggaggacauccccuaccucgggaagcgcgaggaccuguggugcggcucccugaucgggcucagcucccgggcgaccugggccaagaacauccacaccgccaucacccaggugcgcaaccugaucggcaaggaggaguacguggacuacaugccggucaugaagcgguacagcgcccccuccgagagcgagggcgugcuguga

SEQ ID NO: 10477 - RNA, 9867 nt, Artificial Sequence
  derived and/or modified CDS sequence (opt1) from DENV-4__GQ199876__SS-prME
agcaccaucacccugcucugccugauccccacggugauggccuuccaccuguccacccgcgacggcgagccgcucaugaucgucgccaagcacgagcgggggcgcccccugcuguucaagaccaccgagggcaucaacaagugcacgcucaucgcgauggaccugggggagaugugcgaggacaccgugaccuacaagugcccccugcucgugaacaccgagcccgaggacaucgacugcuggugcaaccugacgagcaccugggucauguacggcaccugcacccaguccggggagcggcgccgggagaagcgcagcguggcccugacgccgcacuccggcaugggccucgagacccgggccgagaccuggaugagcuccgagggggccuggaagcacgcccagcgcguggagagcuggauccugcggaaccccggcuucgcgcugcucgccggguucauggccuacaugaucggccagaccgggauccagcgcacggucuucuucgugcugaugaugcugguggcccccuccuacggcaugcggugcgucggcguggggaaccgcgacuucguggagggcgucagcgggggcgcguggguggaccucgugcuggagcacggcgggugcgucaccaccauggcccagggcaagcccacccuggacuucgagcucacgaagaccaccgccaaggagguggcccugcugcggaccuacugcaucgaggcccucaucuccaacaucacgaccgcgacccgcugcccgacccagggggagcccuaccugaaggaggagcaggaccagcaguacaucugccggcgcgacguggucgaccggggcugggggaacggcugcggccuguucgggaagggcgggguggugacgugcgccaaguucagcugcuccggcaagaucaccgggaaccucguccagaucgagaaccuggaguacaccgugguggucaccgugcacaacggcgacacgcacgccgucggcaacgacaccagcaaccacggggugaccgccaccaucacgccccgcucccccagcguggaggucaagcugccggacuacggcgagcucacccuggacugcgagccccgguccgggaucgacuucaacgagaugauccugaugaagaugaagaagaagaccuggcucgugcacaagcagugguuccuggaccugccccuccccuggaccaccggcgccgacacgagcgaggugcacuggaacuacaaggagcgcauggucaccuucaaggugccgcacgcgaagcggcaggacgugaccguccuggggucccaggagggcgccaugcacagcgcccuggccggcgccaccgagguggacagcggggacggcaaccacauguucgcggggcaccucaagugcaaggugcgcauggagaagcugcgcaucaagggcauguccuacacgaugugcagcggcaaguucuccaucgacaaggagauggccgagacccagcacgggaccaccgucgugaaggugaaguacgagggcgccggggcccccugcaagguccccaucgagauccgggacgugaacaaggagaaggugaucggccgcgucaucagcgccacgccccuggcggagaacaccaacuccgugaccaacaucgagcucgagccgcccuucggggacagcuacaucgugaucggcgucggcaacuccgcccugacccugcacugguuccggaaggggagcuccaucggcaagauguucgagagcacguaccgcggggccaagcggauggccauccucggcgagaccgcgugggacuucggguccgugggcggccuguucaccagccuggggaaggccgugcaccaggucuucggcuccguguacaccacgauguucgggggcgugagcuggaugauccgcauccucaucggguuccugguccuguggaucggcaccaacucccggaacaccagcauggccaugaccugcaucgccgugggcgggaucacgcuguuccucggcuucaccgugcaggccgacauggggugcgucguguccuggagcggccgcgagcugaagugcggguccggcaucuucguggucgacaacgugcacaccuggaccgagcaguacaaguuccagcccgagagccccgcgcggcuggccagcgccauccucaacgcccacaaggacggcgugugcgggauccgcuccacgacccggcuggagaacgucauguggaagcagaucaccaacgagcugaacuacgugcucugggagggcgggcacgaccugaccguggucgccggcgacgugaagggcgugcugacgaaggggaagcgcgcgcucaccccgcccgccagcgaccugaaguacuccuggaagaccuggggcaaggccaagaucuucacccccgaggcccggaacagcacguuccugaucgacgggcccgacaccuccgagugcccgaacgagcgccgggccuggaacagcuucgaggucgaggacuacggcuucgggauguucaccaccaacaucuggaugaaguuccgcgagggcuccagcgaggugugcgaccaccggcucauguccgcggccaucaaggaccagaaggccgugcacgccgacaugggcuacuggaucgagagcuccaagaaccagacguggcagaucgagcgcgcgagccugaucgaggucaagaccugccuguggcccaagacccacacccucugguccaacggggugcuggagagccagaugcugauccccaaguccuacgccggcccguucagccagcacaacuaccggcagggguacgccacccagacggugggccccuggcaccucgggaagcuggagaucgacuucggcgagugccccggcaccaccgucaccauccaggagaacugcgaccaccgcgggcccucccugcgcacgaccaccgccagcggcaagcucgugacccaguggugcugccggagcugcacgaugccgccccugcgcuuccugggggaggacggcugcugguacgggauggagauccggccccucuccgagaaggaggagaacauggugaagagccaggucaccgccggccagggcaccuccgagaccuucagcauggggcugcugugccucacgcuguucguggaggagugccugcgccggcgcgucacccggaagcacaugauccucgcgguggugaucacccugugcgccaucauccugggcgggcucaccuggauggaccugcugcgcgcccucaucaugcugggcgacacgauguccggccggaucgggggccagacccaccuggccaucauggccgucuucaagaugagccccggguacgugcucggcguguuccugcgcaagcugaccucccgggagaccgcgcucauggucaucgggauggccaugacgaccacccugagcaucccgcacgaccugauggagcucaucgacggcaucucccugggccugauccuccugaagaucgugacccaguucgacaacacgcagguggggacccuggcccucagccugaccuucauccgcuccaccaugagccuggucauggccuggcggacgaucauggccgugcucuucguggucacccugaucccccugugccgcaccuccugccuccagaagcagagccacuggguggagaucaccgcgcugauccugggcgcccaggcccuccccguguaccugaugacgcugaugaagggggccucccggcgcagcuggccccucaacgagggcaucauggcggucgggcuggugucccugcucggcagcgcccugcugaagaacgacgugccgcucgccggccccauggucgccgggggccugcugcucgccgcguacgugauguccgggagcagcgccgaccugucccuggagaaggccgccaacgugcagugggacgagauggccgacaucaccggcagcucccccaucaucgaggucaagcaggacgaggacgggagcuucuccauccgggacguggaggagaccaacaugaucacccuccuggugaagcuggcgcucaucacggucagcggccuguacccccuggccaucccgaucaccaugacccucugguacauguggcaggugaagacccagcgcuccggcgcccugugggacgugcccagccccgccgccacccagaaggcggcccuguccgagggggucuaccggaucaugcagcgcggccucuucgggaagacgcaggugggcguggggauccacauggagggcgucuuccacaccauguggcacgugacccggggcagcgugaucugccacgagaccgggcgccuggagcccuccugggccgacguccgcaacgacaugaucagcuacggcgggggcuggcggcugggcgacaagugggacaaggaggaggacgugcaggugcucgccaucgagccggggaagaaccccaagcacguccagacgaagcccggccuguucaagacccugaccggggagaucggcgccgugacccucgacuucaagcccgggacguccggcagcccgaucaucaaccgcaagggcaaggugaucgggcuguacggcaacggggucgugaccaaguccggcgacuacgugagcgcgaucacccaggccgagcggaucggggagcccgacuacgaggucgacgaggacaucuuccgcaagaagcggcugaccaucauggaccuccaccccggcgccggcaagacgaagcgcauccugccguccaucgugcgggaggcccugaagcgccggcugcgcacccucauccuggcgcccacccggguggucgccgccgagauggaggaggcccugcgcgggcuccccgugcgguaccagacccccgccgugaagagcgagcacacgggccgcgagaucgucgaccugaugugccacgcgaccuucaccacccggcugcucuccagcacgcgcgugccgaacuacaaccugaucgugauggacgaggcccacuucaccgaccccagcuccgucgccgcccggggguacaucagcacccgcguggagaugggcgaggccgcggccaucuucaugaccgccacgccccccggggccaccgacccguucccccaguccaacagccccaucgaggacaucgagcgggagauccccgagcgcuccuggaacaccggcuucgacuggaucaccgacuaccagggcaagacggucugguucgugccgagcaucaaggccgggaacgacaucgcgaacugccugcgcaaguccggcaagaaggugauccagcucagccggaagaccuucgacaccgaguaccccaagaccaagcugacggacugggacuucgucgugaccaccgacaucuccgagaugggggccaacuuccgcgccggccgggugaucgacccccgccggugccugaagcccgucauccucaccgacgggccggagcgcgugauccuggccggccccauccccgugacgcccgcgagcgccgcccagcggcgcggccggaucgggcgcaacccggcccaggaggacgaccaguacgucuucuccggcgacccccugaagaacgacgaggaccacgcccacuggaccgaggcgaagaugcuccuggacaacaucuacacccccgaggggaucauccccacccuguucggcccggagcgggagaagacgcaggccaucgacggcgaguuccgccuccggggggagcagcgcaagaccuucguggagcugaugcggcgcggcgaccugcccguguggcucagcuacaaggucgccuccgccgggaucagcuacaaggaccgggaguggugcuucaccggcgagcgcaacaaccagauccuggaggagaacauggagguggagaucuggacccgggagggggagaagaagaagcugcgccccaaguggcucgacgcccggguguacgcggaccccauggcccugaaggacuucaaggaguucgccuccggccgcaagagcaucacccuggacauccucacggagaucgccucccugccgaccuaccugagcucccgcgccaagcucgcgcuggacaacaucgucaugcugcacaccaccgagcggggcgggcgcgccuaccagcacgcccucaacgagcugcccgagagccuggagacgcucaugcugguggcccugcucggcgcgaugaccgccgggaucuuccuguucuucaugcagggcaaggggaucggcaagcugagcaugggccucaucaccaucgccguggccuccgggcugcugugggucgccgagauccagccccaguggaucgcggccagcaucauccucgaguucuuccugauggugcugcucaucccggagcccgagaagcagcggaccccccaggacaaccagcugaucuacgugauccugacgauccucaccaucaucggccugaucgccgccaacgagauggggcugaucgagaagaccaagaccgacuucggcuucuaccaggucaagacggagaccaccauccucgacguggaccugcgccccgccuccgcguggacccuguacgccguggccacgaccauccucaccccgaugcugcggcacaccaucgagaacacgagcgccaaccugucccucgccgcgaucgccaaccaggccgccguccugauggggcugggcaagggcuggccccuccaccgcauggaccugggggugccccugcucgccaugggcugcuacagccaggugaaccccaccacccugaccgcgucccuggucaugcuccuggugcacuacgccaucaucgggccgggccugcaggccaaggccacgcgggaggcgcagaagcgcaccgccgccggcaucaugaagaaccccaccguggacgggaucaccgucaucgaccucgagcccaucagcuacgaccccaaguucgagaagcagcugggccaggugaugcugcucgugcugugcgccgggcagcugcuccugaugcggacgaccugggccuucugcgagguccugacccucgcgaccggcccgauccugacgcugugggaggggaaccccggccgcuucuggaacaccaccaucgccguguccaccgccaacaucuuccggggcagcuaccucgccggggccggccuggcguucucccugaucaagaacgcccagacgccccgccgggggaccggcaccaccggggagacccucggcgagaaguggaagcgccagcugaacagccuggaccggaaggaguucgaggaguacaagcgcuccggcauccucgagguggaccggacggaggccaagagcgcccugaaggacggguccaagaucaagcacgccgucagccgcggcuccagcaagauccgguggaucguggagcgcgggauggugaagcccaagggcaaggucguggaccuggggugcggccgcggcgggugguccuacuacauggcgacccucaagaacgugaccgaggucaagggcuacaccaaggggggcccggggcacgaggagcccauccccauggccacguacggcuggaaccuggugaagcugcacagcggcguggacgucuucuacaagcccaccgagcagguggacacccuccugugcgacaucggggagagcuccagcaacccgaccaucgaggagggccggacgcugcgcgugcucaagauggucgagcccuggcuguccagcaagcccgaguucugcaucaaggugcugaaccccuacaugccgaccgugaucgaggagcuggagaagcuccagcggaagcacgggggcaaccugguccgcugcccccugucccggaacagcacccacgagauguacuggguguccggcgccagcgggaacaucgucuccagcgugaacaccacguccaagaugcuccugaaccgcuucaccacccggcaccgcaagcccaccuacgagaaggacguggaccugggcgccgggacgcggagcgucuccaccgagaccgagaagcccgacaugaccaucaucggccgccggcuccagcgccugcaggaggagcacaaggagacguggcacuacgaccaggagaacccguaccggaccugggcguaccacgggagcuacgaggcccccuccaccggcagcgccuccagcauggugaacggcguggucaagcugcucaccaagcccugggacgugaucccgauggugacgcagcuggccaugaccgacaccacccccuucgggcagcagcgcgucuucaaggagaagguggacacgcggaccccccagcccaagccgggcacccgcauggugaugaccacgaccgccaacuggcugugggcgcuccuggggaagaagaagaacccccggcugugcacccgcgaggaguucaucuccaagguccggagcaacgccgccaucggcgccguguuccaggaggagcagggguggaccagcgccuccgaggcggugaacgacagccgcuucugggagcucgucgacaaggagcgggcccugcaccaggagggcaagugcgaguccugcguguacaacaugaugggcaagcgcgagaagaagcugggggaguucggccgcgccaaggggagccgggccaucugguacauguggcucggcgcccgcuuccuggaguucgaggcgcugggguuccucaacgaggaccacugguucggccgggagaacuccuggagcggcguggagggggagggccugcaccgccugggguacauccucgaggagaucgacaagaaggacggcgaccugauguacgccgacgacacggccggcugggacacccggaucaccgaggacgaccugcagaacgaggagcucaucaccgagcagauggccccccaccacaagauccuggcgaaggccaucuucaagcugaccuaccagaacaaggucgugaaggugcuccgccccacgccgcggggggccgucauggacaucaucucccgcaaggaccagcggggcagcgggcaggugggcaccuacgggcugaacaccuucaccaacauggaggugcagcugauccgccagauggaggccgagggcgucaucacgcaggacgacaugcagaaccccaagggccucaaggagcggguggagaaguggcugcgcgagugcgggguggaccggcugaagcgcauggccaucuccggcgacgacugcgucgugaagccccucgacgagcgguucgggaccagccugcuguuccucaacgacaugggcaaggugcgcaaggacaucccccagugggagccguccaagggguggaagaacuggcaggagguccccuucugcagccaccacuuccacaagaucuucaugaaggacggccggucccugguggugcccugccgcaaccaggacgagcugaucggccgggcgcgcaucagccagggggccggcuggucccuccgcgagaccgccugccuggggaaggccuacgcccagauguggagccugauguacuuccaccggcgcgaccuccggcuggcguccauggccaucugcagcgccguccccaccgagugguucccgacgagccgcaccaccugguccauccacgcccaccaccaguggaugaccacggaggacaugcugaagguguggaaccggguguggaucgaggacaaccccaacaugaccgacaagacccccguccacagcugggaggacauccccuaccucggcaagcgcgaggaccuguggugcgggucccugaucggccucagcucccgggccaccugggcgaagaacauccacacggccaucacccaggugcgcaaccugaucggcaaggaggaguacguggacuacaugccggucaugaagcgguacagcgcccccuccgagagcgagggggugcuguga

SEQ ID NO: 10478 - RNA, 9867 nt, Artificial Sequence
  derived and/or modified CDS sequence (opt1) from DENV-4__KP723482__SS-prME
agcaccaugacccugcucugccugauccccaccgugauggccuuccaccugagcacccgggacggcgagccgcucaugaucguggccaagcacgagcgggggcgcccccugcuguucaagaccaccgagggcaucaacaagugcacgcucaucgcgauggaccugggggagaugugcgaggacaccgugaccuacaagugcccccugcucgugaacaccgagcccgaggacaucgacugcuggugcaaccugaccagcaccugggugauguacgggaccugcacccaguccggggagcggcgccgggagaagcgcagcguggcccugacgccgcacuccggcaugggccucgagacccgggccgagaccuggaugagcuccgagggggccuggaagcacgcccagcgcguggagagcuggauccugcggaaccccggcuucgcgcugcucgccggguucauggccuacaugaucggccagaccgggauccagcgcacgguguucuucgugcugaugaugcugguggcccccuccuacggcaugcggugcgugggcguggggaaccgcgacuucguggagggcgucagcgggggcgcguggguggaccucgugcuggagcacggcgggugcgucaccaccauggcccagggcaagcccacccuggacuucgagcucacgaagaccaccgccaaggagguggcccugcugcggaccuacugcaucgaggccuccaucagcaacaucacgaccgcgacccgcugcccgacccagggggagcccuaccucaaggaggagcaggaccagcaguacaucugccggcgcgacguggucgaccggggcugggggaacggcugcggccuguucgggaagggcgggguggugacgugcgccaaguuccugugcuccggcaagaucaccgggaaccucguccagaucgagaaccuggaguacaccgugguggucaccgugcacaacggcaacacgcacgccgucggcaacgacaccagcaaccacggggugaccgccaccaucacgccccgcucccccagcguggaggucaagcugccggacuacggcgagcucacccuggacugcgagccccgguccgggaucgacuucaacgagaugauccugaugaagaugaagaagaagaccuggcucgugcacaagcagugguuccuggaccugccccuccccuggaccgccggcgcggacaccagcgaggugcacuggaacuacaaggagcgcauggucacguucaaggugccgcacgccaagcggcaggacgugaccguccuggggucccaggagggcgccaugcacagcgcccuggccggcgcgaccgagguggacagcggggacggcaaccacauguucgccgggcaccucaagugcaaggugcgcauggagaagcugcgcaucaagggcauguccuacaccaugugcagcggcaaguucuccaucgacaaggagauggccgagacgcagcacgggaccaccgucgugaaggugaaguacgagggcgccggggcccccugcaagguccccaucgagauccgggacgugaacaaggagaagguggucggccgcaucaucagcuccacccccuucgcggagaacacgaacagcgugaccaacaucgagcuggagccgcccuucggggacuccuacaucgugaucggcgucggcgacagcgcccucacccugcacugguuccggaagggguccagcaucggcaagauguucgaguccaccuaccgcggggccaagcggauggccauccugggcgagacggcgugggacuucgggagcgugggcggccucuucaccucccuggggaaggccgugcaccaggucuucggcagcguguacaccaccauguucgggggcguguccuggaugauccgcauccugaucggguuccucguccuguggaucggcacgaacagccggaacaccuccauggccaugaccugcaucgccgugggcgggaucacccuguuccugggcuucacggugcaggccgacauggggugcgucgugagcuggaacggcaaggagcucaagugcggguccggcaucuucguggucgacaacgugcacaccuggaccgagcaguacaaguuccagcccgagagccccgcgcgccuggccagcgccauccugaacgcccacaaggacggcgugugcgggauccgguccaccacgcgccucgagaacgucauguggaagcagaucaccaacgagcugaacuacgugcugugggagggcgggcacgaccucaccguggucgccggcgacgugaagggcgugcugaccaaggggaagcgggcgcugacgccgcccgucaacgaccucaaguacagcuggaagaccuggggcaaggccaagaucuucacccccgaggcccgcaacuccaccuuccugaucgacgggcccgacacgagcgagugcccgaacgagcggcgcgccuggaacuucuucgagguggaggacuacggcuucgggauguucaccaccaacaucuggaugaaguuccgggagggcuccagcgaggugugcgaccaccgccugauguccgccgcgaucaaggaccagaaggccguccacgccgacaugggcuacuggaucgagagcuccaagaaccagaccuggcagaucgagaaggccagccucaucgaggugaagacgugccuguggcccaagacccacacccugugguccaacggggugcucgagagccagaugcugaucccccgguccuacgcgggcccguucagccagcacaacuaccgccagggguacgccacccagaccgccggccccuggcaccuggggaagcucgagaucgacuucggcgagugccccggcacgaccgucaccauccaggaggacugcgaccaccgggggcccucccugcgcaccacgaccgccagcggcaagcuggugacccaguggugcugccgcuccugcaccaugccgccccuccgguuccugggggaggacggcugcugguacgggauggagauccgcccccugagcgagaaggaggagaacauggucaagagccaggucacggccggccagggcaccuccgagaccuucagcauggggcuccugugccugacccucuucguggaggagugccugcggcgccgggucacgcgcaagcacaugauccuggcgguggugaucaccuucugcgccaucauccucggcgggcugaccuggauggaccugcuccggguccugaucaugcugggcgacaccauguccggccgcaucgggggccagauccaccucgccaucauggccguguucaagaugagccccggguacgugcugggcgucuuccugcggaagcucacgucccgcgagaccgcccugauggugaucgggauggcgaugaccaccguguucagcaucccgcacgaccugauggagcucaucgacggcaucucccugggccugauccuccugaagaucgucacgcacuucgacaacacccagguggggacccuggcccucagccugaccuucauccgguccacgacgccccuggugauggccuggcgcaccaucauggccgucuucuucguggugacccucaucccccugugccggacgagcugccugcagaagcagucccacugggucgagaucaccgcccucauccugggcgcgcaggcccugcccguguaccucaugacccugaugaagggggccagccgccgguccuggccgcugaacgagggcaucauggccguggggcucgucagccugcugggcuccgcgcuccugaagaacgacgugccccuggccggccccaugguggccgggggccuccugcuggccgccuacgucaugagcggguccagcgcggaccucucccuggagaaggccgccaacgugcagugggacgagauggccgacaucaccggcagcagccccaucaucgaggugaagcaggacgaggacggguccuucagcauccgcgacgucgaggagacgaacaugaucacccugcucgugaagcuggcccugaucaccguguccggccucuacccgcuggcgauccccgucaccauggcccugugguacguguggcaggucaagacgcagcggagcggcgcccucugggacguccccucccccagcgccacccagaaggccacccuguccgaggggguguaccgcaucaugcagcggggccuguucgggaagacccaggugggcgucgggauccacauggagggcguguuccacaccauguggcacgugacgcgcggcagcgucaucugccacgagaccgggcggcucgagccguccugggcggacgugcgcaacgacaugaucagcuacggcgggggcuggcgccugggcgacaagugggacaaggaggaggacgugcagguccuggccaucgagcccgggaagaaccccaagcacgugcagaccaagcccggccucuucaagacccugacgggggagaucggcgccgugacccuggacuucaagccggggaccuccggcagccccaucaucaacaagaagggcaaggucaucgggcucuacggcaacgggguggugaccaaguccggcgacuacgucagcgccaucacgcaggccgagcggaucggggagcccgacuacgagguggacgaggacaucuuccgcaagaagcggcugaccaucauggaccugcacccgggcgcgggcaagaccaagcgcauccuccccuccaucgugcgggaggcccugaagcgccggcugcgcacccucauccuggcccccacgcgggucguggccgcggagauggaggaggcccugcgcgggcugcccauccgguaccagaccccggccgucaagagcgagcacaccggccgcgagaucgucgaccucaugugccacgccaccuucacgacccggcugcuguccagcacccgcgugcccaacuacaaccucaucgucauggacgaggcccacuucaccgaccccugcuccguggcggcccggggguacaucagcacgcgcguggagaugggcgaggccgccgccaucuucaugaccgcgacgcccccggggagcaucgaccccuucccccaguccaacagccccaucgaggacaucgagcgggagaucccggagcgcuccuggaacaccggcuucgacuggaucacggacuaccagggcaagaccgucugguucgugcccagcaucaaggccgggaacgacaucgccaacugccugcggaaguccggcaagcgcgugauccagcugagccgcaagaccuucgacaccgaguaccccaagacgaagcucaccgacugggacuucgucgugaccaccgacaucuccgagaugggggccaacuuccgggccggccgcgugaucgacccccggcgcugccugaagccggucauccugacggacgggcccgagcgggugauccucgcgggccccauccccgugaccccggccagcgccgcccagcgccggggccgcaucgggcggaaccccgcgcaggaggacgaccaguacgucuucuccggcgacccccugaagaacgacgaggaccacgcccacuggaccgaggccaagaugcugcucgacaacaucuacacccccgaggggaucaucccgacgcuguucggccccgagcgcgagaagacccaggccaucgacggcgaguuccggcugcgcggggagcagcggaagaccuucguggagcucaugcgccggggcgaccugcccguguggcugagcuacaaggucgccuccgcggggaucagcuacaaggaccgcgaguggugcuucaccggcgagcggaacaaccagauccucgaggagaacauggagguggagaucuggacgcgcgagggggagaagaagaagcugcggcccaaguggcuggacgcccgcguguacgccgacccgauggcccucaaggacuucaaggaguucgccuccggccgcaagagcaucacccuggacauccugaccgagaucgcgacccuccccaccuaccuguccagcaaggccaagcuggcccucgacaacaucgucaugcugcacacgaccgagaagggcgggcgcgccuaccagcacgcccugaacgagcuccccgagucccuggagacccugaugcucguggcgcugcugggcgccaugaccgccgggaucuuccucuucuucaugcagggcaaggggaucggcaagcugagcaugggccugaucgccaucgcgguggccuccgggcuccugugggucgccgagauccagccgcaguggaucgccgccagcaucauccuggaguucuuccucauggugcugcugauccccgagcccgagaagcagcgcacgccccaggacaaccagcucaucuacgugauccugaccauccugaccaucaucggccucaucgcggccaacgagauggggcugaucgagaagaccaagacggacuucggcuucuaccaggucaagccggagaccaccauccuggacguggaccuccggcccgccagcgccuggacccuguacgccguggcgacgaccauccugacccccaugcuccgccacaccaucgagaacacguccgccaaccugagccuggccgccaucgccaaccaggcggccguccucauggggcugggcaagggcuggccccugcaccggauggaccucggggugccgcugcuggccaugggcugcuacucccaggugaaccccaccacccucaccgccagccuggucaugcugcucgugcacuacgccaucaucgggcccggccugcaggcgaaggccacgcgcgaggcccagaagcggaccgccgcgggcaucaugaagaaccccaccguggacgggaucaccgucaucgaccuggagccgaucuccuacgaccccaaguucgagaagcagcucggccaggugaugcugcuggugcucugcgucgggcagcugcugcucaugcgcacgaccugggcccugugcgaggugcugacccucgccaccggccccgugaugacgcugugggaggggaaccccggccgguucuggaacaccaccaucgccgucagcaccgccaacaucuuccgcggcuccuaccuggcgggggccggccucgccuucagccugaucaagaacgcccagacgccgcggcgcgggaccggcaccaccggggagacgcugggcgagaaguggaagcggcagcucaacucccuggaccgcaaggaguucgaggaguacaagcggagcggcauccuggagguggaccgcaccgaggccaaguccgcgcuccgggacgggaccaagaucaaguacgccgugagccgcggcuccagcaagauccgguggaucgucgagcgcgggaugaucaagcccaagggcaaggugguggaccuggggugcggccggggcgggugguccuacuacauggccacccugaagaacgucaccgaggugaagggcuacacgaagggcggccccgggcacgaggagcccaucccgauggccaccuacggcuggaaccucgugaagcugcacagcggcgucgacguguucuacaagcccaccgagcaggucgacacccugcucugcgacaucggggaguccagcuccaaccccacgaucgaggagggccgcacccugcgcguccugaagaugguggagcccuggcucagcagcaagccggaguucugcaucaagguccugaaccccuacaugcccaccgugaucgaggagcuggagaagcuccagcggcgccacgggggcucccuggugcggugcccccugagccgcaacuccacccacgagauguacugggucagcggcgccuccgggaacaucgugagcuccgugaacacgaucagcaagaugcugcucaaccgguucaccacccgccaccggaagccgaccuacgagaaggacgucgaccugggcgcggggacgcgcuccgugagcaccgagaccgagaagcccgacaugaccgugaucggccggcgccugcagcggcuccgcgaggagcacaaggagacguggcacuacgaccaggagaaccccuaccggaccugggccuaccacggguccuacgaggccccgagcaccggcuccgccagcuccauggucaacggcguggugaagcugcugaccaagcccugggacgucauccccauggugacgcagcucgcgaugaccgacaccacccccuucgggcagcagcgcguguucaaggagaaggucgacacgcggaccccgcagcccaagcccggcacccgcaugaucaugaccacgaccgccaacuggcugugggcccugcucgggaagaagaaguccccgcggcugugcacccgcgaggaguucaucuccaaggugcggagcaacgccgccaucggcgcgguguuccaggaggagcagggguggaccuccgccagcgaggccgucaacgacagccgcuucugggagcugguggacaaggagcgggcccuccaccaggagggcaagugcgaguccugcguguacaacaugaugggcaagcgcgagaagaagcugggggaguucggccgcgccaaggggagccgggcgaucugguacauguggcugggcgcccgcuuccucgaguucgaggcccugggguuccugaacgaggaccacugguucucccgggagaacagcugguccggcgucgagggcgaggggcuccaccgccugggcuacauccuggaggacaucgacaagaaggacggggaccucaucuacgccgacgacacggccggcugggacacccggaucaccgaggacgaccugcugaacgaggagcucaucaccgagcagauggcgccccaccacaagacgcuggccaaggccaucuucaagcugaccuaccagaacaagguggugaagguccuccgccccacccccaagggcgccgugauggacaucaucagccggaaggaccagcgcggguccggccagguggggaccuacggccugaacaccuucacgaacauggagguccagcugauccggcagauggaggcggagggggugaucacccaggacgacaugcagaaccccaagggccucaaggagcgcguggagaaguggcugaaggagugcggcgucgaccggcugaagcgcauggccaucagcggggacgacugcguggugaagccgcucgacgagcgguucuccaccagccugcuguuccucaacgacaugggcaagguccgcaaggacaucccccagugggagcccuccaagggguggaagaacuggcaggaggugcccuucugcagccaccacuuccacaagaucuucaugaaggacggccggucccugguggucccgugccgcaaccaggacgagcugaucgggcgggcccgcaucagccagggcgccggcuggucccuccgggagaccgccugccuggggaaggcguacgcccagauguggagccugauguacuuccaccgccgcgaccuccggcuggccuccauggccaucugcagcgccgugcccacggagugguuccccaccagccgcaccaccugguccauccacgcgcaccaccaguggaugacgaccgaggacaugcugaagguguggaaccgggucuggaucgaggacaaccccaacaugaccgacaagaccccggugcacagcugggaggacauccccuaccucggcaagcgcgaggaccuguggugcgggucccugaucggccucagcucccgggccacgugggccaagaacauccacaccgccaucacccaggugcgcaaccugaucgggaaggaggaguacgucgacuacaugcccgccaugaagcgguacagcgcgcccuucgaguccgagggcgugcuguga

SEQ ID NO: 10479 - RNA, 9867 nt, Artificial Sequence
  derived and/or modified CDS sequence (opt1) from DENV-4__JN638570__SS-prME
agcaccaucacccugcucugccugauccccaccgugauggcguuccaccuguccacccgcgacggcgagccgcucaugaucgucgccaagcacgagcgggggcgcccccugcuguucaagaccaccgagggcaucaacaagugcacgcucaucgcgauggaccugggggagaugugcgaggacaccgugaccuacaagugcccccugcucgugaacaccgagcccgaggacaucgacugcuggugcaaccugacgagcgccugggucauguacgggaccugcacccaguccggggagcggcgccgggagaagcgcagcguggcccugacgccccacuccggcaugggccucgagacccgggccgagaccuggaugagcuccgagggggccuggaagcacgcgcagcgcguggagagcuggauccugcggaaccccggcuucgcccugcucgccggguucauggccuacaugaucggccagaccgggauccagcgcaccgucuucuucauccugaugaugcugguggcgcccuccuacggcaugcggugcgugggcgucgggaaccgcgacuucguggagggcgugagcgggggcgccugggucgaccucgugcuggagcacggcgggugcgugacgaccauggcccagggcaagcccacccuggacuucgagcucaucaagaccacggccaaggaggucgcccugcugcggaccuacugcaucgaggcguccaucagcaacaucaccaccgccacgcgcugcccgacccagggggagcccuaccucaaggaggagcaggaccagcaguacaucugccggcgcgacaugguggaccggggcugggggaacggcugcggccuguucgggaagggcgggguggugaccugcgccaaguucuccugccugggcaagaucaccgggaaccucgugcagaucgagaaccuggaguacacgguggucgugaccgugcacaacggcgacacccacgccgucggcaacgacaccagcaaccacggggugacggccaccaucacgccccgcucccccagcgucgaggugaagcugccggacuacggcgagcucacccuggacugcgagccccgguccgggaucgacuucaacgagaugauccugaugaagaugaagacgaagaccuggcucgugcacaagcagugguuccuggaccugccccuccccuggaccaccggcgcggacacccuggagguccacuggaaccacaaggagcgcauggugacguucaaggugccgcacgccaagcggcaggacgucaccgugcuggggagccaggagggcgccaugcacuccgcccucgccggcgcgaccgagguggacagcggggacggcaaccacauguucgccgggcaccugaagugcaagguccgcauggagaagcugcgcaucaagggcaugagcuacaccaugugcuccggcaaguucagcaucgacaaggagauggccgagacgcagcacgggaccaccguggugaaggucaaguacgagggcaccggggcccccugcaaggugcccaucgagauccgggacgugaacaaggagaaggucgugggccgcaucaucuccagcacgcccuucgccgagaacaccaacuccgugaccaacaucgagcucgagccgcccuucggggacagcuacaucgucaucggcgugggcgacggggcgcugacccugcacugguuccggaagggcuccagcaucgggaagauguucgaguccacguaccgcggcgccaagcggauggccauccucggggagaccgccugggacuucggcagcgugggcgggcugcugaccucccucggcaaggcgguccaccagguguucgggagcguguacaccacgauguucggcggggucuccuggauggugcgcauccugaucggccugcuggugcucuggaucggcaccaacagccggaacaccuccauggccaugagcugcaucgccgucgggggcaucacccuguuccugggguucacggugcacgccgacaugggcugcguggucuccuggagcgggaaggagcucaagugcggcuccggcaucuucgugaucgacaacgugcacaccuggaccgagcaguacaaguuccagcccgagagccccgcccgccuggcgagcgccauccugaacgcccacaaggagggggucugcggcauccgguccaccacgcgccucgagaacgugauguggaagcagaucaccaacgagcugaacuacgugcugugggagggcgggcacgaccucaccgucguggccggcgacgugaaggggguccugagcaagggcaagcgggcccuggcgccgcccgugaacgaccucaaguacuccuggaagaccugggggaaggccaagaucuucacgcccgagacccgcaacagcaccuuccugguggacggccccgacaccuccgagugcccgaacgagcggcgcgccuggaacuuccuggaggucgaggacuacggguucggcauguucacgaccaacaucuggaugaaguuccgggagggcagccccgaggugugcgaccaccgccucauguccgccgccaucaaggaccagaaggcggugcacgccgacaugggguacuggaucgagagcuccaagaaccagaccuggcagaucgagaaggccagccugaucgaggucaagaccugccuguggcccaagacgcacacccucugguccaacggcgugcuggagagccagaugcugaucccgaaggccuacgcggggcccaucucccagcacaacuaccggcagggcuacgccacccagaccgccgggcccuggcaccucggcaagcuggagaucgacuucggcgagugccccgggaccacggugaccguccaggaggacugcgaccaccgcggcccgagccugcggaccaccacggccuccgggaagcucgugacccaguggugcugccgcagcugcaccaugccgccccugcgcuuccugggcgaggacgggugcugguacggcauggagauccggccccucaacgagaaggaggagaacauggugaagucccaggucagcgccggccaggggaccagcgagacguucuccaugggccugcugugccucacccuguucguggaggagugccugcgccggcgcgucacccggaagcacaugaugcucgugguggucaccacgcugugcgcgaucauccucgggggccucaccuggauggaccugcugcgcgcccucaucaugcugggcgacaccaugagcgggcggaugggcgggcagauccaccuggccaucauggccguguucaagauguccccgggcuacgugcucgggaucuuccugcgcaagcugaccagccgggagacggcccucauggucaucggcauggcgaugaccaccgugcuggccaucccccacgaccugauggaguucaucgacggcaucucccucgggcugauccugcucaagauggugacccacuucgacaacacgcaggucggcacccuggcccuggcccucaccuucaucaagagcaccaugccccuggugauggccuggcgcacgaucauggcggugcuguucgucgugacccucaucccccugugccggaccuccugccugcagaagcagagccacuggguggagaucaccgcccucauccugggggcccaggcccugccggucuaccucaugacgcugaugaagggcgcguccaagcgcagcuggccccugaacgaggggaucauggccgugggccucgugucccugcugggcagcgcccuccugaagaacgacgucccccuggccgggcccaugguggccggcgggcuccugcuggcggccuacgugauguccggcagcuccgccgaccucagccuggagaaggccgccaacguccggugggacgagauggcggacaucaccggguccagcccgaucaucgaggugaagcaggacgaggacggcuccuucagcauccgcgacguggaggagaccaacaugaucacccugcucgucaagcuggcccugaucacggugagcggccucuacccccuggccauccccgugaccaugacccugugguacauguggcaggucaagacccagcgguccggggcccucugggacgugcccagcccggccgcggcccagaaggccacgcugaccgagggcguguaccgcaucaugcagcgggggcuguucggcaagacccaggucggggugggcauccacaccgagggcguguuccacaccauguggcacgucacgcgcggguccgugaucugccacgagagcggccggcucgagcccuccugggccgacgugcgcaacgacaugaucagcuacgggggcggcuggcggcugggggacaagugggacaaggaggaggacguccaggugcuggccaucgagcccggcaagaaccccaagcacgugcagaccaagccggggcuguucaagacccugaccggcgagaucggggcggucacgcuggacuucaagcccggcaccuccggcagccccaucaucaaccgcaaggggaaggugaucggccucuacgggaacggcguggucaccaaguccggggacuacgugagcgccaucacccaggccgagcgcaucggcgagccggacuacgagguggacgaggacaucuuccggaagaagcgccugacgaucauggaccugcaccccggcgccgggaagaccaagcggauccugcccuccaucguccgcgaggcgcucaagcggcgccugcggacccugauccucgcccccacccgcgugguggccgccgagauggaggaggcccugcggggccugccgauccgcuaccagacgcccgcggucaagagcgagcacaccgggcgggagaucguggaccucaugugccacgccaccuucaccacgcgccugcuguccagcacccgggugcccaacuacaaccucaucgucauggacgaggcccacuucaccgaccccuccagcguggccgcccgcggcuacaucuccacccgggucgagaugggggaggcggccgccaucuucaugacggccaccccgcccggcaccaccgaccccuucccccagagcaacuccccgaucgaggacaucgagcgcgagauccccgagcggagcuggaacacgggcuucgacuggaucaccgacuaccaggggaagaccgugugguucgugcccagcaucaaggccggcaacgacaucgcgaacugccugcgcaaguccgggaagaaggucauccagcugagccggaagaccuucgacacggaguaccccaagaccaagcucaccgacugggacuucguggugaccacggacaucuccgagaugggcgccaacuuccgcgccgggcgcgucaucgacccgcggcgcugccugaagcccgugauccugaccgacggccccgagcgggugauccucgccggccccaucccggucacccccgcgagcgccgcccagcgccgggggcgcaucggccggaaccccgcccaggaggacgaccaguacguguucuccggggacccccugcgcaacgacgaggaccacgcccacuggaccgaggcgaagaugcugcucgacaacaucuacacgccggagggcaucauccccacccuguucggccccgagcgggagaagacccaggccaucgacggggaguuccgccugcggggcgagcagcgcaagaccuucguggagcucaugcggcgcggggaccugcccgucuggcugagcuacaagguggccuccgccggcaucagcuacaaggaccgggaguggugcuucacgggggagcgcaacaaccagauccucgaggagaacauggagguggagaucuggacccgggagggcgagaagaagaagcugcgcccgaaguggcuggacgcccgggucuacgcggaccccauggcccucaaggacuucaaggaguucgccuccggccgcaagagcaucacccuggacauccugaccgagaucgccucccuccccaccuaccugagcucccgggccaagcuggcgcucgacaacaucgugaugcugcacacgaccgagcgcgggggcaaggccuaccagcacgcccugaacgagcucccggagagccuggagacccugaugcucguggcccugcugggggcgaugaccgccggcaucuuccucuucuucaugcaggggaagggcaucggcaagcuguccauggggcugaucgccaucgccgucgccagcggccuccuguggguggcggagauccagccccaguggaucgccgccuccaucauccuggaguucuuccucauggugcugcugguccccgagcccgagaagcagcgcacgccgcaggacaaccagcucaucuacgugauccugaccauccugaccaucaucgcccucguggccgcgaacgagauggggcugaucgagaagaccaagacggacuucggcuucuaccaggucaaggccgagaccaccauccuggacguggaccuccggcccgccagcgccuggacccuguacgccguggcgacgaccauccugacccccaugcuccgccacaccaucgagaacacguccgccaaccugagccuggccgccaucgccaaccaggcggccguccucauggggcugggcaagggcuggccccugcaccggauggaccucggggugccgcugcuggccaugggcugcuacagccaggugaaccccaccacccucaccgccucccuggucaugcugcucgugcacuacgcgaucaucgggcccggccugcaggccaaggccacgcgcgaggcccagaagcggaccgccgcgggcaucaugaagaaccccaccguggacgggaucaccgucaucgaccuggagccgaucagcuacgaccccaaguucgagaagcagcucggccaggugaugcugcuggugcucugcgccgggcagcugcugcucaugcgcacgaccugggccuucugcgagguccugacccuggccaccggccccauccucacgcugugggaggggaaccccggccgguucuggaacaccaccaucgccguguccaccgcgaacaucuuccgcggcagcuaccuggccggggccggccucgccuucucccugaucaagaacgcccagacgccgcggcgcgggaccggcaccaccggggagacgcugggcgagaaguggaagcggcagcucaacagccuggaccgcaaggaguucgaggaguacaagcgguccggcauccuggagguggaccgcaccgaggccaagagcgcccucaaggacggguccaagaucaaguacgccgucagccggggcaccuccaagauccgcuggaucguggagcgggggauggugaagcccaagggcaaggucguggaccuggggugcggccgcggcggguggagcuacuacauggccacccugaagaacgugaccgaggucaagggcuacacgaagggcggccccgggcacgaggagcccaucccgauggcgaccuacggcuggaaccucgugaagcugcacuccggcguggacgucuucuacaagcccaccgagcaggucgacacccugcucugcgacaucggggagagcuccagcaaccccacgaucgaggagggccggacccugcgcgugcugaagauggucgagcccuggcuguccagcaagccggaguucugcaucaaggugcucaaccccuacaugcccaccgucaucgaggagcuggagaagcugcagcgccgguacgggggcucccucgugcgcugcccccugagccggaacagcacccacgagauguacuggguguccggcgucagcgggaacaucguguccagcgugaacacgaccuccaagaugcugcucaaccgcuucaccacccggcaccgcaagccgacguacgagcgggacgccgaccugggcgccgggacccgcagcgucuccaccgagaccgagaagcccgacaugacgaucaucggccggcgccugcagcggcuccaggaggagcacaaggagaccuggcacuacgaccacgagaaccccuaccgcaccugggccuaccacgggagcuacgaggccccguccaccggcagcgcguccagcauggugaacggcguggucaagcugcugacgaagcccugggacguggugcccauggucacccagcucgccaugaccgacaccacgcccuucgggcagcagcggguguucaaggagaagguggacacccgcaccccgcagcccaagcccggcacccgggucgugaugacgaccaccgccaacuggcuguggacccugcucgggcgcaagaagaacccccggcugugcacgcgcgaggaguucaucuccaaggugcggagcaacgccgccaucggcgcggucuuccaggaggagcagggguggaccuccgccagcgaggccgugaacgacucccgcuucugggagcugguggacaaggagcgggcccuccaccaggagggcaagugcgagagcugcgucuacaacaugaugggcaagcgcgagaagaagcugggggaguucggccgcgccaaggggucccgggcgaucugguacauguggcugggcgcccgcuuccucgaguucgaggcccugggguuccugaacgaggaccacugguucggccgggagaacagcuggagcggcguggagggggagggccuccaccgccugggguacauccuggaggacaucgacaagaaggacggcgaccucaucuacgccgacgacaccgcgggcugggacacccggaucacggaggacgaccugcugaacgaggagcucaucaccgagcagauggccccgcaccacaagauccuggccaaggccaucuucaagcugaccuaccagaacaagguggucaaggugcuccgccccacccccaagggggccgugauggacaucaucucccggaaggaccagcgcggcagcgggcaggucggcaccuacgggcugaacacguucaccaacauggaggugcagcugauccggcagauggaggcggagggcgugaucacccgcgacgacaugcacaaccccaagggccucaaggagcgggucgagaaguggcugaaggagugcgggguggaccgccugaagcggauggccaucuccggcgacgacugcguggucaagccgcucgacgagcgcuucagcaccucccugcuguuccucaacgacauggggaaggugcggaaggacaucccccagugggagcccagcaagggcuggaagaacuggcaggaggugcccuucugcucccaccacuuccacaagaucuucaugaaggacgggcgcagccuggucgugccgugccggaaccaggacgagcugaucggccgcgcccggaucucccagggcgccggguggagccuccgcgagacggccugccugggcaaggcguacgcccagauguggucccugauguacuuccaccgccgggaccuccgccuggccagcauggccaucugcuccgccgugcccaccgagugguuccccaccagccggaccacgugguccauccacgcgcaccaccaguggaugaccaccgaggacaugcugaaggucuggaaccgcguguggaucgaggacaaccccaacaugaucgacaagaccccggugcacagcugggaggacauccccuaccucgggaagcgggaggaccuguggugcggcucccugaucgggcucagcagccgcgccacgugggccaagaacauccacaccgccaucacccagguccggaaccugaucggcaaggaggaguacguggacuacaugcccgccaugcgccgguacuccgcgcacuucgagagcgagggcgugcuguga

SEQ ID NO: 10480 - RNA, 9867 nt, Artificial Sequence
  derived and/or modified CDS sequence (opt1) from DENV-4__JN638571__SS-prME
agcaccaucacccugcucugccugauccccaccgugauggccuuccaccuguccacccgcgacggcgagccgcucaugaucguggccaagcacgagcgggggcgcccccugcuguucaagaccaccgagggcaucaacaagugcacccucaucgccauggaccugggggagaugugcgaggacaccgugaccuacaagugcccccugcucgugaacaccgagcccgaggacaucgacugcuggugcaaccugaccagcgccugggucauguacgggaccugcacccaguccggggagcggcgccgggagaagcgcagcguggcccugaccccgcacuccggcaugggccucgagacgcgggccgagaccuggaugagcuccgagggggccuggaagcacgcgcagcgcguggagagcuggauccugcggaaccccggcuucgcccugcucgccggguucauggccuacaugaucggccagaccgggauccagcgcaccgucuucuucauccugaugaugcugguggcgcccuccuacggcaugcggugcgugggcgucgggaaccgcgacuucguggagggcgugagcgggggcgccugggucgaccucgugcuggagcacggcgggugcgugacgaccauggcccagggcaagcccacccuggacuucgagcucaucaagaccacggccaaggaggucgcccugcugcggaccuacugcaucgaggcguccaucagcaacaucaccaccgccacgcgcugcccgacccagggggagcccuaccucaaggaggagcaggaccagcaguacaucugccggcgcgacaugguggaccggggcugggggaacggcugcggccuguucgggaagggcgggguggugaccugcgccaaguucuccugccugggcaagaucaccgggaaccucgugcagaucgagaaccuggaguacacgguggucgugaccgugcacaacggcgacacccacgccgucggcaacgacaccagcaaccacggggugacggccaccaucacgccccgcucccccagcgucgaggugaagcugccggaguacggcgagcucacccuggacugcgagccccgguccgggaucgacuucaacgagaugauccugaugaagaugaagacgaagaccuggcucgugcacaagcagugguuccuggaccugccccuccccuggaccaccggcgcggacacccuggagguccacuggaaccacaaggagcgcauggugacguucaaggugccgcacgccaagcggcaggacgucaccgugcuggggagccaggagggcgccaugcacuccgcccucgccggcgcgaccgagguggacagcggggacggcaaccacauguucgccgggcaccugaagugcaagguccgcauggagaagcugcgcaucaagggcaugagcuacaccaugugcuccggcaaguucagcaucgacaaggagauggccgagacgcagcacgggaccaccguggugaaggucaaguacgagggcaccggggcccccugcaaggugcccaucgagauccgggacgugaacaaggagaaggucgugggccgcaucaucuccagcacgcccuucgccgagaacaccaacuccgugaccaacaucgagcucgagccgcccuucggggacagcuacaucgucaucggcgugggcgacggggcgcugacccugcacugguuccggaagggcuccagcaucgggaagauguucgaguccacguaccgcggcgccaagcggauggccauccucggggagaccgccugggacuucggcagcgugggcgggcugcugaccucccucggcaaggcgguccaccagguguucgggagcguguacaccacgauguucggcggggucuccuggauggugcgcauccugaucggccugcuggugcucuggaucggcaccaacagccggaacaccuccauggccaugagcugcaucgccgucgggggcaucacccuguuccugggguucacggugcacgccgacaugggcugcguggucuccuggagcgggaaggagcucaagugcggcuccggcaucuucgugaucgacaacgugcacaccuggaccgagcaguacaaguuccagcccgagagccccgcccgccuggcgagcgccauccugaacgcccacaaggagggggucugcggcauccgguccaccacgcgccucgagaacgugauguggaagcagaucaccaacgagcugaacuacgugcugugggagggcgggcacgaccucaccgucguggccggcgacgugaaggggguccugagcaagggcaagcgggcccuggcgccgcccgugaacgaccucaaguacuccuggaagaccugggggaaggccaagaucuucacgcccgagacccgcaacagcaccuuccugguggacggccccgacaccuccgagugcccgaacgagcggcgcgccuggaacuuccuggaggucgaggacuacggguucggcauguucacgaccaacaucuggaugaaguuccgggagggcagcuccgaggugugcgaccaccgccucaugagcgccgccaucaaggaccagaaggcggugcacgccgacaugggguacuggaucgaguccagcaagaaccagaccuggcagaucgagaaggccucccugaucgaggucaagaccugccuguggcccaagacgcacacccucuggagcaacggcgugcuggagucccagaugcugauccccaaggccuacgcggggccgaucagccagcacaacuaccggcagggcuacgccacccagaccgccgggcccuggcaccucggcaagcuggagaucgacuucggcgagugccccgggaccacggugaccguccaggaggacugcgaccaccgcggccccucccugcggaccaccacggccagcgggaagcucgugacccaguggugcugccgcuccugcaccaugccgccccugcgcuuccugggcgaggacgggugcugguacggcauggagauccggccccucaacgagaaggaggagaacauggucaagagccaggucagcgccggccaggggaccuccgagacguucagcaugggccugcugugccucacccuguucguggaggagugccugcgccggcgcgucacccggaagcacaugaugcucgugguggucaccacgcugugcgcgaucauccucgggggccucaccuggauggaccugcugcgcgcccucaucaugcugggcgacaccauguccgggcggaugggcgggcagauccaccuggccaucauggccguguucaagaugagccccggcuacgugcucgggaucuuccugcgcaagcugaccucccgggagacggcccucauggucaucggcauggcgaugaccaccgugcuggccaucccgcacgaccugauggaguucaucgacggcaucagccucgggcugauccugcucaagauggugacccacuucgacaacacgcaggucggcacccuggcccuggcccucaccuucaucaaguccaccaugccccuggugauggccuggcgcacgaucauggcggugcuguucgucgugacccucaucccccugugccggaccagcugccugcagaagcagucccacuggguggagaucaccgcccucauccugggggcccaggcccugcccgucuaccucaugacgcugaugaagggcgcgagcaagcgcuccuggccgcugaacgaggggaucauggccgugggccucgugagccugcugggcuccgcccuccugaagaacgacgucccccuggccgggcccaugguggccggcgggcuccugcuggcggccuacgugaugagcggcuccagcgccgaccucucccuggagaaggccgccaacguccggugggacgagauggcggacaucaccgggagcucccccaucaucgaggugaagcaggacgaggacggcagcuucagcauccgcgacguggaggagaccaacaugaucacccugcucgucaagcuggcccugaucacgguguccggccucuacccgcuggccauccccgugaccaugacccugugguacauguggcaggucaagacccagcggagcggggcccucugggacgugcccucccccgccgcggcccagaaggccacgcugaccgagggcguguaccgcaucaugcagcgggggcuguucggcaagacccaggucggggugggcauccacaccgagggcguguuccacaccauguggcacgucacgcgcgggagcgugaucugccacgaguccggccggcucgagccgagcugggccgacgugcgcaacgacaugaucuccuacgggggcggcuggcggcugggggacaagugggacaaggaggaggacguccaggugcuggccaucgagcccggcaagaaccccaagcacgugcagaccaagcccgggcuguucaagacccugaccggcgagaucggggcggucacgcuggacuucaagccgggcaccagcggcucccccaucaucaaccgcaaggggaaggugaucggccucuacgggaacggcguggucaccaagagcggggacuacguguccgccaucacccaggccgagcgcaucggcgagcccgacuacgagguggacgaggacaucuuccggaagaagcgccugacgaucauggaccugcacccgggcgccgggaagaccaagcggauccugcccagcaucguccgcgaggcgcucaagcggcgccugcggacccugauccucgcccccacccgcgugguggccgccgagauggaggaggcccugcggggccugcccauccgcuaccagacgccggcggucaaguccgagcacaccgggcgggagaucguggaccucaugugccacgccaccuucaccacgcgccugcugagcuccacccgggugcccaacuacaaccucaucgucauggacgaggcccacuucaccgaccccagcuccguggccgcccgcggcuacaucagcacccgggucgagaugggggaggcggccgccaucuucaugacggccacgcccccgggcaccaccgaccccuucccccaguccaacagccccaucgaggacaucgagcgcgagaucccggagcggagcuggaacacgggcuucgacuggaucaccgacuaccaggggaagaccgugugguucgugcccuccaucaaggccggcaacgacaucgcgaacugccugcgcaagagcgggaagaaggucauccagcugucccggaagaccuucgacacggaguaccccaagaccaagcucaccgacugggacuucguggugaccacggacaucagcgagaugggcgccaacuuccgcgccgggcgcgucaucgacccccggcgcugccugaagccggugauccugaccgacggccccgagcgggugauccucgccggccccauccccgucaccccggcguccgccgcccagcgccgggggcgcaucggccggaaccccgcccaggaggacgaccaguacguguucagcggggacccccugcgcaacgacgaggaccacgcccacuggaccgaggcgaagaugcugcucgacaacaucuacacgcccgagggcaucaucccgacccuguucggccccgagcgggagaagacccaggccaucgacggggaguuccgccugcggggcgagcagcgcaagaccuucguggagcucaugcggcgcggggaccugcccgucuggcuguccuacaagguggccagcgccggcaucuccuacaaggaccgggaguggugcuucacgggggagcgcaacaaccagauccucgaggagaacauggagguggagaucuggacccgggagggcgagaagaagaagcugcgccccaaguggcuggacgcccgggucuacgcggacccgauggcccucaaggacuucaaggaguucgccagcggccgcaaguccaucacccuggacauccugaccgagaucgccagccuccccaccuaccuguccagccgggccaagcuggcgcucgacaacaucgugaugcugcacacgaccgagcgcgggggcaaggccuaccagcacgcccugaacgagcuccccgagucccuggagacccugaugcucguggcccugcugggggcgaugaccgccggcaucuuccucuucuucaugcaggggaagggcaucggcaagcugagcauggggcugaucgccaucgccgucgccuccggccuccuguggguggcggagauccagccgcaguggaucgccgccagcaucauccuggaguucuuccucauggugcugcugguccccgagcccgagaagcagcgcacgccccaggacaaccagcucaucuacgugauccugaccauccugaccaucaucgcccucguggccgcgaacgagauggggcugaucgagaagaccaagacggacuucggcuucuaccaggucaaggccgagaccaccauccuggacguggaccuccggccggccuccgccuggacccuguacgccguggcgacgaccauccugacccccaugcuccgccacaccaucgagaacacgagcgccaaccugagccuggccgccaucgccaaccaggcggccguccucauggggcugggcaagggcuggccccugcaccggauggaccucggggugccccugcuggccaugggcugcuacucccaggugaacccgaccacccucaccgccagccuggucaugcugcucgugcacuacgcgaucaucgggcccggccugcaggccaaggccacgcgcgaggcccagaagcggaccgccgcgggcaucaugaagaaccccaccguggacgggaucaccgucaucgaccuggagcccaucuccuacgacccgaaguucgagaagcagcucggccaggugaugcugcuggugcucugcgccgggcagcugcugcucaugcgcacgaccugggccuucugcgagguccugacccuggccaccggccccauccucacgcugugggaggggaaccccggccgguucuggaacaccaccaucgccgugagcaccgcgaacaucuuccgcggcuccuaccuggccggggccggccucgccuucagccugaucaagaacgcccagacgccccggcgcgggaccggcaccaccggggagacgcugggcgagaaguggaagcggcagcucaacucccuggaccgcaaggaguucgaggaguacaagcggagcggcauccuggagguggaccgcaccgaggcgaaguccgcccucaaggacgggagcaagaucaaguacgccgucucccggggcaccagcaagauccgcuggaucguggagcgggggauggugaagccgaagggcaaggucguggaccuggggugcggccgcggcgggugguccuacuacauggccacccugaagaacgugaccgaggucaagggcuacacgaagggcggccccgggcacgaggagcccauccccauggcgaccuacggcuggaaccucgugaagcugcacagcggcguggacgucuucuacaagccgaccgagcaggucgacacccugcucugcgacaucggggaguccagcuccaaccccacgaucgaggagggccggacccugcgcgugcugaagauggucgagcccuggcugagcuccaagcccgaguucugcaucaaggugcucaacccguacaugcccaccgucaucgaggagcuggagaagcugcagcgccgguacgggggcagccucgugcgcugcccccugagccggaacuccacccacgagauguacugggugagcggcgucuccgggaacaucgugagcuccgugaacacgaccagcaagaugcugcucaaccgcuucaccacccggcaccgcaagcccacguacgagcgggacgccgaccugggcgccgggacccgcuccgucagcaccgagaccgagaagccggacaugacgaucaucggccggcgccugcagcggcuccaggaggagcacaaggagaccuggcacuacgaccacgagaaccccuaccgcaccugggccuaccacggguccuacgaggcccccagcaccggcuccgcgagcuccauggugaacggcguggucaagcugcugacgaagccgugggacguggugcccauggucacccagcucgccaugaccgacaccacgcccuucgggcagcagcggguguucaaggagaagguggacacccgcacgccccagccgaagcccggcacccgggucgugaugacgaccaccgccaacuggcuguggacccugcucgggcgcaagaagaacccccggcugugcacgcgcgaggaguucaucagcaaggugcggcugaacgccgccaucggcgcggucuuccaggaggagcagggguggaccuccgccagcgaggccgugaacgacucccgcuucugggagcucguggacaaggagcgggcccugcaccaggagggcaagugcgagagcugcgucuacaacaugaugggcaagcgcgagaagaagcugggggaguucggccgcgccaaggggucccgggcgaucugguacauguggcucggcgcccgcuuccuggaguucgaggcccugggguuccucaacgaggaccacugguucggccgggagaacagcuggagcggcguggagggggagggccugcaccgccugggguacauccucgaggacaucgacaagaaggacggcgaccugaucuacgccgacgacaccgcgggcugggacacccggaucacggaggacgaccugcucaacgaggagcugaucaccgagcagauggcgccccaccacaagauccuggccaaggccaucuucaagcucaccuaccagaacaagguggucaaggugcugcgcccgacccccaagggggccgugauggacaucaucucccggaaggaccagcgcggcagcgggcaggucggcaccuacgggcugaacacguucaccaacauggaggugcagcucauccggcagauggaggcggagggcgugaucacccgcgacgacaugcacaaccccaagggccugaaggagcgggucgagaaguggcugaaggagugcgggguggaccgccucaagcggauggccaucuccggcgacgacugcguggucaagccccuggacgagcgcuucagcaccucccuccuguuccugaacgacauggggaaggugcggaaggacaucccgcagugggagcccagcaagggcuggaagaacuggcaggaggugcccuucugcucccaccacuuccacaagaucuucaugaaggacgggcgcagccuggucgugcccugccggaaccaggacgagcucaucggccgcgcccggaucucccagggcgccggguggagccugcgcgagacggccugccugggcaaggcguacgcccagauguggucccucauguacuuccaccgccgggaccugcgccuggccagcauggccaucugcuccgccgugccgaccgagugguuccccaccagccggaccacgugguccauccacgcgcaccaccaguggaugaccaccgaggacaugcucaaggucuggaaccgcguguggaucgaggacaaccccaacaugaucgacaagacccccgugcacagcugggaggacaucccguaccuggggaagcgggaggaccuguggugcggcucccucaucgggcugagcagccgcgccacgugggccaagaacauccacaccgccaucacccagguccggaaccugaucggcaaggaggaguacguggacuacaugcccgccaugcgccgguacuccgcgcacuucgagagcgagggcgugcucuga

SEQ ID NO: 10481 - RNA, 9867 nt, Artificial Sequence
  derived and/or modified CDS sequence (opt1) from DENV-4__JN638572__SS-prME
agcaccaucacccugcucugccugauccccaccgugauggccuuccaccuguccacccgcgacggcgagccgcucaugaucguggccaagcacgagcgggggcgcccccugcuguucaagaccaccgagggcaucaacaagugcacccucaucgcgauggaccugggggagaugugcgaggacaccgugaccuacaagugcccccugcucgugaacaccgagcccgaggacaucgacugcuggugcaaccugacgagcgccugggugauguacgggaccugcacccaguccggggagcggcgccgggagaagcgcagcguggcccugaccccgcacuccggcaugggccucgagacgcgggccgagaccuggaugagcuccgagggggccuggaagcacgcgcagcgcguggagagcuggauccugcggaaccccggcuucgcccugcucgccggguucauggccuacaugaucggccagaccgggauccagcgcaccguguucuucauccugaugaugcugguggcgcccuccuacggcaugcggugcgugggcgucgggaaccgcgacuucguggagggcgugagcgggggcgccugggucgaccucgugcuggagcacggcgggugcgugacgaccauggcccagggcaagcccacccuggacuucgagcucaucaagaccacggccaaggaggucgcccugcugcggaccuacugcaucgaggcguccaucagcaacaucaccaccgccacgcgcugcccgacccagggggagcccuaccucaaggaggagcaggaccagcaguacaucugccggcgcgacaugguggaccggggcugggggaacggcugcggccuguucgggaagggcgggguggugaccugcgccaaguucuccugccugggcaagaucaccgggaaccucgugcagaucgagaaccuggaguacacgguggucgugaccgugcacaacggcgacacccacgccgucggcaacgacaccagcaaccacggggugacggccaccaucacgccccgcucccccagcgucgaggugaagcugccggaguacggcgagcucacccuggacugcgagccccgguccgggaucgacuucaacgagaugauccugaugaagaugaagacgaagaccuggcucgugcacaagcagugguuccuggaccugccccuccccuggaccaccggcgcggacacccuggagguccacuggaaccacaaggagcgcauggugacguucaaggugccgcacgccaagcggcaggacgucaccgugcuggggagccaggagggcgccaugcacuccgcccucgccggcgcgaccgagguggacagcggggacggcaaccacauguucgccgggcaccugaagugcaagguccgcauggagaagcugcgcaucaagggcaugagcuacaccaugugcuccggcaaguucagcaucgacaaggagauggccgagacgcagcacgggaccaccguggugaaggucaaguacgagggcaccggggcccccugcaaggugcccaucgagauccgggacgugaacaaggagaaggucgugggccgcaucaucuccagcacgcccuucgccgagaacaccaacuccgugaccaacaucgagcucgagccgcccuucggggacagcuacaucgucaucggcgugggcgacggggcgcugacccugcacugguuccggaagggcuccagcaucgggaagauguucgaguccacguaccgcggcgccaagcggauggccauccucggggagaccgccugggacuucggcagcgugggcgggcugcugaccucccucggcaaggcgguccaccagguguucgggagcguguacaccacgauguucggcggggucuccuggauggugcgcauccugaucggccugcuggugcucuggaucggcaccaacagccggaacaccuccauggccaugagcugcaucgccgucgggggcaucacccuguuccugggguucacggugcacgccgacaugggcugcguggucuccuggagcgggaaggagcucaagugcggcuccggcguguucgugaucgacaacguccacaccuggaccgagcaguacaaguuccagcccgagagccccgcccgccuggcgagcgccauccugaacgcccacaaggagggggugugcggcauccgguccaccacgcgccucgagaacgugauguggaagcagaucaccaacgagcugaacuacguccugugggagggcgggcacgaccucaccgugguggccggcgacgucaagggggugcugagcaagggcaagcgggcccuggcgccgcccgugaacgaccucaaguacuccuggaagaccugggggaaggccaagaucuucacgcccgagacccgcaacagcaccuuccuggucgacggccccgacaccuccgagugcccgaacgagcggcgcgccuggaacuuccuggagguggaggacuacggguucggcauguucacgaccaacaucuggaugaaguuccgggagggcagcuccgaggugugcgaccaccgccucaugagcgccgccaucaaggaccagaaggcgguccacgccgacaugggguacuggaucgaguccagcaagaaccagaccuggcagaucgagaaggccucccugaucgaggugaagaccugccuguggcccaagacgcacacccucuggagcaacggcgugcuggagucccagaugcugauccccaaggccuacgcggggccgaucagccagcacaacuaccggcagggcuacgccacccagaccgccgggcccuggcaccucggcaagcuggagaucgacuucggcgagugccccgggaccacggucaccgugcaggaggacugcgaccaccgcggccccucccugcggaccaccacggccagcgggaagcucgugacccaguggugcugccgcuccugcaccaugccgccccugcgcuuccugggcgaggacgggugcugguacggcauggagauccggccccucaacgagaaggaggagaacauggucaagagccaggugagcgccggccaggggaccuccgagacguucagcaugggccugcugugccucacccuguucgucgaggagugccugcgccggcgcgugacccggaagcacaugauccucguggucgugaccacgcugugcgcgaucauccucggcgggcucaccuggauggaccugcugcgcgcccucaucaugcugggggacaccauguccgggcggaugggcgggcagauccaccuggccaucauggccguguucaagaugagccccggcuacguccucgggaucuuccugcgcaagcugaccucccgggagacggcccucauggugaucggcauggcgaugaccaccgugcuggccaucccgcacgaccugauggaguucaucgacggcaucagccucgggcugauccugcucaagauggucacccacuucgacaacacccaggucggcacccuggcccuggcccucaccuucaucaaguccaccaugccccuggugauggccuggcgcacgaucauggcgguccuguucguggugacccucaucccccugugccggaccagcugccugcagaagcagucccacugggucgagaucaccgcccucauccugggggcccaggcccugcccguguaccucaugacgcugaugaagggcgcgagcaagcgcuccuggccgcugaacgaggggaucauggccgugggccucgucagccugcugggcuccgcccuccugaagaacgacgugccccuggccgggcccaugguggccggcgggcuccugcuggcggccuacgucaugagcggcuccagcgccgaccucucccuggagaaggccgccaacgugcggugggacgagauggcggacaucaccgggagcucccccaucaucgaggugaagcaggacgaggacggcagcuucagcauccgcgacgucgaggagaccaacaugaucacccugcucgugaagcuggcccugaucacgguguccggccucuacccgcuggccauccccgucaccaugacccugugguacauguggcaggucaagacccagcggagcggggcccucugggacgugcccucccccgccgcggcccagaaggccacgcugaccgagggcgucuaccgcaucaugcagcgggggcuguucggcaagacccaggugggggugggcauccacaccgagggcgucuuccacaccauguggcacgugacgcgcgggagcgugaucugccacgaguccggccggcucgagccgagcugggccgacguccgcaacgacaugaucuccuacgggggcggcuggcggcugggggacaagugggacaaggaggaggacguccaggugcuggccaucgagcccggcaagaaccccaagcacguccagaccaagcccgggcuguucaagacccugaccggcgagaucggggcggugacgcuggacuucaagccgggcaccagcggcucccccaucaucaaccgcaaggggaaggugaucggccucuacgggaacggcgucgugaccaagagcggggacuacguguccgccaucacccaggccgagcgcaucggcgagcccgacuacgaggucgacgaggacaucuuccggaagaagcgccugacgaucauggaccugcacccgggcgccgggaagaccaagcggauccugcccagcaucgugcgcgaggcgcucaagcggcgccugcggacccugauccucgcccccacccgcguggucgccgccgagauggaggaggcccugcggggccugcccauccgcuaccagacgccggcggugaaguccgagcacaccgggcgggagaucguggaccucaugugccacgccaccuucaccacgcgccugcugagcuccacccggguccccaacuacaaccucaucgugauggacgaggcccacuucaccgaccccagcuccgucgccgcccgcggcuacaucagcacccggguggagaugggggaggcggccgccaucuucaugacggccacgcccccgggcaccaccgaccccuucccccaguccaacagccccaucgaggacaucgagcgcgagaucccggagcggagcuggaacacgggcuucgacuggaucaccgacuaccaggggaagaccgugugguucguccccuccaucaaggccggcaacgacaucgcgaacugccugcgcaagagcgggaagaaggugauccagcugucccggaagaccuucgacacggaguaccccaagaccaagcucaccgacugggacuucguggucaccacggacaucagcgagaugggcgccaacuuccgcgccgggcgcgugaucgacccccggcgcugccugaagccggugauccugaccgacggccccgagcgggucauccucgccggccccauccccgugaccccggcguccgccgcccagcgccgggggcgcaucggccggaaccccgcccaggaggacgaccaguacguguucagcggggacccccugcgcaacgacgaggaccacgcccacuggaccgaggcgaagaugcugcucgacaacaucuacacgcccgagggcaucaucccgacccuguucggccccgagcgggagaagacccaggccaucgacggggaguuccgccugcggggcgagcagcgcaagaccuucgucgagcucaugcggcgcggggaccugcccguguggcuguccuacaagguggccagcgccggcaucuccuacaaggaccgggaguggugcuucacgggggagcgcaacaaccagauccucgaggagaacauggaggucgagaucuggacccgggagggcgagaagaagaagcugcgccccaaguggcuggacgcccggguguacgcggacccgauggcccucaaggacuucaaggaguucgccagcggccgcaaguccaucacccuggacauccugaccgagaucgccagccuccccaccuaccuguccagccgggccaagcuggcgcucgacaacaucgugaugcugcacacgaccgagcgcgggggcaaggccuaccagcacgcccugaacgagcuccccgagucccuggagacccugaugcucgucgcccugcugggggcgaugaccgccggcaucuuccucuucuucaugcaggggaagggcaucggcaagcugagcauggggcugaucgccaucgccguggccuccggccuccuguggguggcggagauccagccgcaguggaucgccgccagcaucauccuggaguucuuccucaugguccugcuggugcccgagcccgagaagcagcgcacgccccaggacaaccagcucaucuacgugauccugaccauccugaccaucaucgcccucgucgccgcgaacgagauggggcugaucgagaagaccaagacggacuucggcuucuaccaggugaaggccgagaccaccauccuggacguggaccuccggccggccuccgccuggacccuguacgccgucgcgacgaccauccugacccccaugcuccgccacaccaucgagaacacgagcgccaaccugagccuggccgccaucgccaaccaggcggccgugcucauggggcugggcaagggcuggccccugcaccggauggaccucggggugccccugcuggccaugggcugcuacucccaggucaacccgaccacccucaccgccagccuggugaugcugcucgugcacuacgcgaucaucgggcccggccugcaggccaaggccacgcgcgaggcccagaagcggaccgccgcgggcaucaugaagaaccccaccgucgacgggaucaccgugaucgaccuggagcccaucuccuacgacccgaaguucgagaagcagcucggccaggugaugcugcugguccucugcguggggcagcugcugcucaugcgcacgaccugggcccugugcgaggugcugacccucgccaccggccccaucaugacgcugugggaggggaaccccggccgguucuggaacaccaccaucgccgucagcaccgccaacaucuuccgcggcuccuaccuggcgggggccggccucgccuucagccugaucaagaacgcccagacgccccggcgcgggaccggcaccaccggggagacgcugggcgagaaguggaagcggcagcucaacucccuggaccgcaaggaguucgaggaguacaagcggagcggcauccuggagguggaccgcaccgaggccaaguccgcgcuccgggacgggagcaagaccaagcacgccgugucccgcggcagcuccaagauccgguggaucgucgagcgcgggaugaucaagccgaagggcaaggugguggaccuggggugcggccggggcggguggagcuacuacauggccacccugcagaacgucaccgaggugaagggcuacacgaagggcggccccgggcacgaggagcccauccccauggccaccuacggcuggaaccucgugaagcugcacuccggcgucgacguguucuacaagccgaccgagcaggucgacacccugcucugcgacaucggggagagcuccagcaaccccacgaucgaggagggccgcacccugcgcguccugaagaugguggagcccuggcuguccagcaagcccgaguucugcaucaagguccucaacccguacaugcccaccgugaucgaggagcuggagaagcugcagcggcgcuacgggggcagccucgugcggugcccccugucccgcaacagcacccacgagauguacugggucuccggcgugagcgggaacaucguguccagcgucaacacgaccuccaagaugcugcucaaccgguucaccacccgccaccggaagcccacguacgagcgcgacgcggaccugggcgccgggacccggagcguguccaccgagaccgagaagccggacaugacgaucaucggccgccggcugcagcgccuccaggaggagcacaaggagaccuggcacuacgaccacgagaaccccuaccggaccugggccuaccacgggagcuacgaggcccccuccaccggcagcgccuccagcauggugaacggcgucgugaagcugcugacgaagccgugggacgugguccccauggugacccagcucgcgaugaccgacaccacgcccuucgggcagcagcgcguguucaaggagaaggucgacacccggacgccccagccgaagcccggcacccgcguggugaugacgaccaccgccaacuggcuguggacccugcucgggcggaagaagaacccccgccugugcacgcgggaggaguucaucuccaagguccgcagcaacgccgccaucggcgccguguuccaggaggagcagggguggaccuccgcgagcgaggccgugaacgacucccgguucugggagcuggucgacaaggagcgcgcccuccaccaggagggcaagugcgagagcugcguguacaacaugaugggcaagcgcgagaagaagcugggggaguucggccgggccaaggggagccgcgccaucugguacauguggcugggcgcgcgguuccucgaguucgaggcccugggguuccugaacgaggaccacugguucggccgcgagaacuccuggagcggcguggagggggagggccuccaccggcugggguacauccuggaggacaucgacaagaaggacggcgaccucaucuacgccgacgacaccgccggcugggacacccgcaucacggaggacgaccugcugaacgaggagcucaucaccgagcagauggcgccccaccacaagguccuggccaaggccaucuucaagcugaccuaccagaacaagguggugaagguccuccggccgacccccaagggggccgugauggacaucaucucccgcaaggaccagcggggcagcggccaggugggcaccuacgggcugaacacguucaccaacauggagguccagcugauccgccagauggaggccgagggcgugaucacccgggacgacaugcacaaccccaagggccucaaggagcgcguggagaaguggcugaaggagugcggggucgaccggcugaagcgcauggcgaucuccggcgacgacugcguggugaagccccucgacgagcgguucagcaccucccugcuguuccucaacgacauggggaagguccgcaaggacaucccgcagugggagcccagcaagggcuggaagaacuggcaggaggugcccuucugcucccaccacuuccacaagaucuucaugaaggacgggcggagccuggugguccccugccgcaaccaggacgagcugaucggccgggcccgcaucucccagggcgccggguggagccuccgcgagacggccugccugggcaaggccuacgcgcagauguggucccugauguacuuccaccggcgcgaccuccggcuggccagcauggccaucugcuccgccgugccgaccgagugguuccccaccagccgcaccacgugguccauccacgcccaccaccaguggaugaccaccgaggacaugcugaagguguggaaccgggucuggaucgaggacaaccccaacaugaccgacaagacgcccgugcacagcugggaggacaucccguaccucgggaagcgcgaggaccuguggugcggcagccugaucgggcucuccagccgggcgaccugggccaagaacauccacaccgccaucacccaggugcgcaaccugaucggcaaggaggaguacauggacuacaugcccgucaugaagcgguacuccgcccccagcgaguccgagggcgugcuguga

SEQ ID NO: 10482 - RNA, 9867 nt, Artificial Sequence
  derived and/or modified CDS sequence (opt1) from DENV-4__JX024757__SS-prME
agcaccaugacccugcucugccugauccccacggugauggccuuccaccuguccacccgcgacggcgagccgcucaugaucguggccaagcacgagcgggggcgcccccugcuguucaagaccaccgagggcaucaacaagugcacgcucaucgccauggaccugggggagaugugcgaggacaccgugaccuacaagugcccccugcucgugaacaccgagcccgaggacaucgacugcuggugcaaccugacgagcaccugggugauguacgggaccugcacccaguccggggagcggcgccgggagaagcgcagcguggcccugacgccgcacuccggcaugggccucgagacccgggccgagaccuggaugagcuccgagggggccuggaagcacgcccagcgcguggagagcuggauccugcggaaccccggcuucgcgcugcucgccggguucauggccuacaugaucggccagaccgggauccagcgcacggucuucuucgugcugaugaugcugguggcccccuccuacggcaugcggugcgucggcguggggaaccgcgacuucguggagggcgucagcgggggcgcguggguggaccucgugcuggagcacggcgggugcgucaccaccauggcccagggcaagcccacccuggacuucgagcucacgaagaccaccgccaaggagguggcccugcugcggaccuacugcaucgaggccuccaucagcaacaucacgaccgcgacccgcugcccgacccagggggagcccuaccucaaggaggagcaggaccagcaguacaucugccggcgcgacguggucgaccggggcugggggaacggcugcggccuguucgggaagggcgggguggugacgugcgccaaguuccugugcuccggcaagaucaccgggaaccucguccagaucgagaaccuggaguacaccgugguggucaccgugcacaacggcgacacgcacgccgucggcaacgacaccagcaaccacggggugaccgccaccaucacgccccgcucccccagcguggaggucaagcugccggacuacggcgagcucacccuggacugcgagccccgguccgggaucgacuucaacgagaugauccugaugaagaugaagaagaagaccuggcucgugcacaagcagugguuccuggaccugccccuccccuggagcgccggcgcggacaccuccgaggugcacuggaacuacaaggagcgcauggucaccuucaaggugccgcacgccaagcggcaggacgugacgguccuggggagccaggagggcgccaugcacagcgcccuggccggcgcgaccgagguggacuccggggacggcaaccacauguucgccgggcaccucaagugcaaggugcgcauggagaagcugcgcaucaagggcaugagcuacaccaugugcuccggcaaguucagcaucgacaaggagauggccgagacccagcacgggacgaccgucgugaaggugaaguacgagggcgccggggcccccugcaagguccccaucgagauccgggacgugaacaaggagaagguggucggccgcaucaucuccagcacccccuucgcggagaacaccaacuccgugacgaacaucgagcuggagccgcccuucggggacagcuacaucgugaucggcgucggcgacuccgcccucacccugcacugguuccggaaggggagcuccaucggcaagauguucgagagcaccuaccgcggggccaagcggauggccauccugggcgagaccgcgugggacuucggguccgugggcggccucuucacgagccuggggaaggccgugcaccaggucuucggcuccguguacaccaccauguucgggggcgugagcuggaugauccgcauccugaucggguuccucguccuguggaucggcaccaacucccggaacacgagcauggccaugaccugcaucgccgugggcgggaucacccuguuccugggcuucaccgugcaggccgacauggggugcgucguguccuggaacggcaaggagcucaagugcgggagcggcaucuucguggucgacaacgugcacacguggaccgagcaguacaaguuccagcccgagagccccgcgcgccuggccuccgccauccugaacgcccacaaggacggcgugugcgggauccggagcaccacccgccucgagaacgucauguggaagcagaucacgaacgagcugaacuacgugcugugggagggcgggcacgaccucaccguggucgccggcgacgugaagggcgugcugaccaaggggaagcgggcgcugaccccgcccgucaacgaccucaaguacuccuggaagacguggggcaaggccaagaucuucacccccgaggcccgcaacagcaccuuccugaucgacgggcccgacaccuccgagugcccgaacggccggcgcgccuggaacuuccuggagguggaggacuacggguucggcauguucacgaccaacaucuggaugaaguuccgggagggcagcuccgaggugugcgaccaccgccucaugagcgccgcgaucaaggaccagaaggccguccacgccgacaugggguacuggaucgaguccagcaagaaccagaccuggcagaucgagaaggccucccugaucgaggugaagaccugccuguggcccaagacgcacacccucuggagcaacggcgugcuggagucccagaugcugaucccccggagcuacgcggggccguucucccagcacaacuaccgccagggcuacgccacccagaccgccgggcccuggcaccucggcaagcuggagaucgacuucggcgagugccccgggaccacggucaccauccaggaggacugcgaccaccggggccccagccugcgcaccaccacggccuccgggaagcucgugacccaguggugcugccgcagcugcaccaugccgccccugcgguuccugggcgaggacgggugcugguacggcauggagauccgcccccucagcgagaaggaggagaacauggugaagucccaggucaccgccggccaggggacgagcgagaccuucuccaugggccugcugugccucacccuguucguggaggagugccugcggcgccgggucacccgcaaguacaugaugcucgugguggucaucacguucugcgcgaucauccucggcgggcugaccuggauggaccuccugcgggcccugaucaugcucggggacaccaugagcgggcgcaucggcgggcagauccaccuggccaucauggccguguucaagaugucccccggcuacgugcugggggucuuccuccggaagcugaccagccgcgagacggcccugauggugaucggcauggcgaugaccaccguguucuccaucccgcacgaccucauggagcugaucgacggcaucagccuggggcucauccugcugcggaucgucacccacuucgacaacacccaggugggcacccucgcccugucccugaccuucauccgcagcaccacgccccucgugauggccuggcggaccaucauggccgucuucuucguggugacccugaucccccugugccgcaccuccugccuccagaagcagagccacugggucgagaucacggcccugauccugggggcgcaggcccuccccguguaccugaugacccugaugaagggcgccucccggcgcagcuggccgcucaacgaggggaucauggccgugggccuggucucccugcucggcagcgcgcugcugaagaacgacgugccccucgccgggcccaugguggccggcgggcugcugcucgccgccuacgucauguccggcagcuccgcggaccugagccuggagaaggccgccaacgugcagugggacgagauggccgacaucaccgggagcucccccaucaucgaggugaagcaggacgaggacggcagcuucuccauccgggacgucgaggagaccaacaugaucacgcuccuggugaagcuggcccucaucaccgugagcggccuguacccgcuggcgauccccgucaccauggcccucugguacaucuggcaggucaagacccagcgcuccggggcccugugggacgugcccagccccgccgccacgcagaaggcgacccuguccgagggcgucuaccggaucaugcagcgcgggcuguucggcaagacccaggugggggugggcauccacauggagggcgucuuccacaccauguggcacgugacccgggggagcgugaucugccacgagacgggccgccuggagccguccugggccgacguccgcaacgacaugaucagcuacgggggcggcuggcggcugggggacaagugggacaaggaggaggacguccaggugcucgccaucgagcccggcaagaaccccaagcacguccagaccaagcccgggcuguucaagacccugaccggcgagaucggggccgugacgcucgacuucaagccgggcaccuccggcagccccaucaucaacaagaaggggaaggugaucggccuguacgggaacggcgucgugaccaaguccggggacuacgugagcgccaucacccaggcggagcgcaucggcgagcccgacuacgaggucgacgaggacaucuuccggaagaagcgccugacgaucauggaccuccacccgggcgccgggaagaccaagcggauccugcccuccaucgugcgcgaggcccugaagcggcgccuccggacccugauccuggcccccacccgcguggucgcggccgagauggaggaggcccugcggggccuccccauccgcuaccagacgccggccgugaaguccgagcacaccgggcgggagaucguggaccugaugugccacgccaccuucaccacgcgccugcucuccagcacccggguccccaacuacaaccugaucgugauggacgaggcgcacuucaccgaccccugcuccgucgccgcccgcggcuacaucagcacccggguggagaugggggaggccgccgcgaucuucaugacggccacgcccccgggcagcaucgaccccuucccccaguccaacagccccaucgaggacaucgagcgcgagaucccggagcgguccuggaacaccggcuucgacuggaucaccgacuaccaggggaagacggugugguucguccccagcaucaaggccggcaacgacaucgccaacugccugcgcaaguccgggaagcgcgugauccagcucagccggaagaccuucgacaccgaguaccccaagaccaagcugacggacugggacuucguggucaccaccgacaucuccgagaugggcgccaacuuccgcgcggggcgggugaucgacccccgccggugccugaagccggugauccucaccgacggccccgagcgcgucauccuggccggccccauccccgugacgccggccagcgccgcgcagcggcgcgggcggaucggccgcaaccccgcccaggaggacgaccaguacguguucuccggggacccccugaagaacgacgaggaccacgcccacuggaccgaggccaagaugcuccuggacaacaucuacacccccgagggcaucaucccgacccuguucggccccgagcgggagaagacgcaggccaucgacggggaguuccgccuccggggcgagcagcgcaagaccuucgucgagcugaugcggcgcggggaccugcccguguggcucagcuacaagguggcguccgccggcaucagcuacaaggaccgggaguggugcuucaccggggagcgcaacaaccagauccuggaggagaacauggaggucgagaucuggacccgggagggcgagaagaagaagcugcgccccaaguggcucgacgcccggguguacgccgacccgauggcccugaaggacuucaaggaguucgcguccggccgcaagagcaucacgcuggacauccucaccgagaucgccacccugcccaccuaccuguccagcaaggccaagcucgcccuggacaacaucgugaugcugcacaccacggagaagggcggccgcgccuaccagcacgcgcucaacgagcugcccgagucccuggagacccucaugcuggucgcccugcucggggcccugaccgccggcaucuuccuguucuucaugcaggggaagggcaucggcaagcucagcauggggcugaucgcgaucgccguggccuccggccugcucuggguggccgagauccagccgcaguggaucgccgcgagcaucauccuggaguucuuccugaugguccuccugauccccgagcccgagaagcagcggacgccccaggacaaccagcugaucuacgugauccucacgauccugaccaucaucgggcugaucgccgccaacgagaugggccucaucgagaagaccaagaccgacuucggguucuaccaggugaagacggagaccaccauccuggacgucgaccugcgcccggccagcgccuggacccucuacgcgguggccacgaccauccugacccccaugcugcggcacaccaucgagaacacguccgccaaccucagccuggccgccaucgcgaaccaggccgccgugcugaugggccucggcaagggguggccccugcaccgcauggaccugggcgucccccuccuggccauggggugcuacucccaggugaacccgaccacccugaccgccagccucgugaugcugcugguccacuacgcgaucaucggccccggccuccaggccaaggccacgcgggaggcccagaagcgcaccgcggccgggaucaugaagaaccccaccguggacggcaucaccgugaucgaccuggagcccaucuccuacgacccgaaguucgagaagcagcuggggcaggucaugcuccuggugcugugcgugggccagcuccugcugaugcggacgaccugggcccucugcgagguccugacccuggccaccgggcccaucaugacgcucugggagggcaaccccggccgcuucuggaacaccaccaucgccgugagcaccgcgaacaucuuccggggguccuaccuggccggcgccgggcuggccuucagccucaucaagaacgcccagacgccccgccggggcaccgggaccaccggcgagacgcugggcgagaaguggaagcgccagcugaacucccucgaccggaaggaguucgaggaguacaagcgcagcgggauccuggagguggaccggaccgaggcgaaguccgcccugcgcgacggcagcaagaucaagcacgccgucucccgggggagcuccaagauccgcuggaucguggagcggggcaugaucaagccgaaggggaagguggucgaccucggcugcggccgcgggggcuggagcuacuacauggccacccugaagaacgugaccgaggugaagggguacaccaagggcgggcccggccacgaggagcccauccccauggccacguacggcuggaaccuggucaagcuccacuccgggguggacguguucuacaagccgaccgagcaggucgacacccugcugugcgacaucggcgagagcuccagcaaccccaccaucgaggaggggcgcacgcuccgggugcugaagaugguggagcccuggcugagcuccaagcccgaguucugcaucaagguccucaacccguacaugcccaccgugaucgaggagcuggagaagcugcagcgccggcacggcggcagccugguccgcugcccccucucccggaacagcacccacgagauguacuggguguccggggcgagcggcaacaucguguccagcgucaacaccaucuccaagaugcugcugaaccgcuucacgacccggcaccgcaagcccaccuacgagaaggacguggaccucggggccggcacccggagcguguccacggagaccgagaagccggacaugaccaucaucgggcgccggcugcagcgccugcgggaggagcacaaggagaccuggcacuacgaccaggagaaccccuaccgcacgugggccuaccacggcagcuacgaggcccccuccaccggcagcgcguccagcauggucaacgggguggugaagcuccugaccaagccgugggacgucauccccauggugacccagcuggccaugacggacaccacccccuucggccagcagcggguguucaaggagaaggucgacacccgcacgccccagccgaagcccgggacccggaugaucaugaccaugaccgccaacuggcucugggcccugcugggcaagaagaaguccccgcgccucugcacgcgggaggaguucaucagcaaggugcgcagcaacgccgcgaucggggccguguuccaggaggagcagggcuggaccagcgccagcgaggccgucaacgacucccgguucugggagcugguggacaaggagcgcgcccugcaccaggagggcaagugcgagagcugcguguacaacaugauggggaagcgcgagaagaagcucggcgaguucgggcgggcgaagggcucccgcgccaucugguacauguggcugggggcccgguuccuggaguucgaggcccucggcuuccugaacgaggaccacugguucagccgcgagaacuccuggagcggcgucgagggggagggccugcaccggcucggguacauccuggaggacaucgacaagaaggacggcgaccugaucuacgccgacgacaccgcgggcugggacacccgcaucacggaggacgaccuccugaacgaggagcugaucaccgagcagauggcgccccaccacaagacccucgccaaggccaucuucaagcugaccuaccagaacaagguggugaagguccugcggcccacgcccaagggggcggugauggacaucaucucccgcaaggaccagcggggcagcggccaggugggcaccuacgggcucaacaccuucaccaacauggagguccagcugauccgccagauggaggccgagggcgugaucacccaggacgacaugcagaacccccggggccugaaggagcgcguggagaaguggcucaaggagugcggggucgaccggcugaagcgcauggccaucuccggcgacgacugcguggugaagcccaucgacgagcgguucagcacgucccuccuguuccugaacgacauggggaagguccgcaaggacaucccgcagugggagcccagcaagggcuggaagaacuggcaggaggugcccuucugcucccaccacuuccacaagaucuucaugaaggacgggcggagccuggugguccccugccgcaaccaggacgagcucaucggccgggcccgcaucucccagggcgccggguggagccugcgcgagaccgcgugccugggcaaggccuacgcccagauguggucccucauguacuuccaccggcgcgaccugcggcuggccagcauggccaucugcagcgcggugccgaccgagugguuccccaccucccgcacgaccuggagcauccacgcccaccaccaguggaugaccaccgaggacaugcucaagguguggaaccgggucuggaucgaggacaaccccaacaugacggacaagacccccgugcacuccugggaggacaucccguaccuggggaagcgcgaggaccuguggugcggcagccucaucgggcuguccagccgggccaccugggccaagaacauccacaccgccaucacccaggugcgcaaccugaucggcaaggaggaguacgucgacuacaugcccgcgaugaagcgguacuccgcccccuucgagagcgagggcgugcucuga

SEQ ID NO: 10483 - RNA, 9867 nt, Artificial Sequence
  derived and/or modified CDS sequence (opt1) from DENV-4__JF741967__SS-prME
agcaccaugacccugcucugccugauccccaccgugauggccuuccaccuguccacccgggacggcgagccgcucaugaucguggccaagcacgagcgggggcgcccccugcuguucaagaccaccgagggcaucaacaagugcacgcucaucgcgauggaccugggggagaugugcgaggacaccgugaccuacaagugcccccugcucgugaacaccgagcccgaggacaucgacugcuggugcaaccugaccagcaccugggucauguacgggaccugcacccaguccggggagcggcgccgggagaagcgcagcguggcccugacgccgcacuccggcaugggccucgagacccgggccgagaccuggaugagcuccgagggggccuggaagcacgcccagcgcguggagagcuggauccugcggaaccccggcuucgcgcugcucgccggguucauggccuacaugaucggccagaccgggauccagcgcacggucuucuucgugcugaugaugcugguggcccccuccuacggcaugcggugcgucggcguggggaaccgcgacuucguggagggcgucagcgggggcgcguggguggaccucgugcuggagcacggcgggugcgucaccaccauggcccagggcaagcccacccuggacuucgagcucacgaagaccaccgccaaggagguggcccugcugcggaccuacugcaucgaggccuccaucagcaacaucacgaccgcgacccgcugcccgacccagggggagcccuaccucaaggaggagcaggaccagcaguacaucugccggcgcgacguggucgaccggggcugggggaacggcugcggccuguucgggaagggcgggguggugacgugcgccaaguuccugugcuccggcaagaucaccgggaaccucguccagaucgagaaccuggaguacaccgugguggucaccgugcacaacggcaacacgcacgccgucggcaacgacaccagcaaccacggggugaccgccaccaucacgccccgcucccccagcguggaggucaagcugccggacuacggcgagcucacccuggacugcgagccccgguccgggaucgacuucaacgagaugauccugaugaagaugaagaagaagaccuggcucgugcacaagcagugguuccuggaccugccccuccccuggaccgccggcgcggacaccagcgaggugcacuggaacuacaaggagcgcauggucacguucaaggugccgcacgccaagcggcaggacgugaccguccuggggucccaggagggcgccaugcacagcgcccuggccggcgcgaccgagguggacagcggggacggcaaccacauguucgccgggcaccucaagugcaaggugcgcauggagaagcugcgcaucaagggcauguccuacaccaugugcagcggcaaguucuccaucgacaaggagauggccgagacgcagcacgggaccaccgucgugaaggugaaguacgagggcgccggggcccccugcaagguccccaucgagauccgggacgugaacaaggagaagguggucggccgcaucaucagcuccacccccuucgcggagaacacgaacagcgugaccaacaucgagcuggagccgcccuucggggacuccuacaucgugaucggcgucggcgacagcgcccucacccugcacugguuccggaagggguccagcaucggcaagauguucgaguccaccuaccgcggggccaagcggauggccauccugggcgagacggcgugggacuucgggagcgugggcggccucuucaccucccuggggaaggccgugcaccaggucuucggcagcguguacaccaccauguucgggggcguguccuggaugauccgcauccugaucggguuccucguccuguggaucggcacgaacagccggaacaccuccauggccaugaccugcaucgccgugggcgggaucacccuguuccugggcuucacggugcaggccgacauggggugcgucgugagcuggaacggcaaggagcucaagugcggguccggcaucuucguggucgacaacgugcacaccuggaccgagcaguacaaguuccagcccgagagccccgcgcgccuggccagcgccauccugaacgcccacaaggacggcgugugcgggauccgguccaccacgcgccucgagaacgucauguggaagcagaucaccaacgagcugaacuacgugcugugggagggcgggcacgaccucaccguggucgccggcgacgugaagggcgugcugaccaaggggaagcgggcgcugacgccgcccgucaacgaccucaaguacagcuggaagaccuggggcaaggccaagaucuucacccccgaggcccgcaacuccaccuuccugaucgacgggcccgacacgagcgagugcccgaacgagcggcgcgccuggaacuucuucgagguggaggacuacggcuucgggauguucaccaccaacaucuggaugaaguuccgggagggcuccagcgaggugugcgaccaccgccugauguccgccgcgaucaaggaccagaaggccguccacgccgacaugggcuacuggaucgagagcuccaagaaccagaccuggcagaucgagaaggccagccucaucgaggugaagacgugccuguggcccaagacccacacccugugguccaacggggugcucgagagccagaugcugaucccccgguccuacgcgggcccguucagccagcacaacuaccgccagggguacgccacccagaccgccggccccuggcaccuggggaagcucgagaucgacuucggcgagugccccggcacgaccgucaccauccaggaggacugcgaccaccgggggcccucccugcgcaccacgaccgccagcggcaagcuggugacccaguggugcugccgcuccugcaccaugccgccccuccgguuccugggggaggacggcugcugguacgggauggagauccgcccccugagcgagaaggaggagaacauggugaagucccaggucacggccggccagggcaccuccgagaccuucagcauggggcuccugugccugacccucuucguggaggagugccugcggcgccgggucacgcgcaagcacaugauccuggcgguggugaucaccuucugcgccaucauccucggcgggcugaccuggauggaccugcuccggguccugaucaugcugggcgacaccauguccggccgcaucgggggccagauccaccucgccaucauggccguguucaagaugagccccggguacgugcugggcgucuuccugcggaagcucacgucccgcgagaccgcccugauggugaucgggauggcgaugaccaccguguucagcaucccgcacgaccugauggagcucaucgacggcaucucccugggccugauccuccugaagaucgucacgcacuucgacaacacccagguggggacccuggcccucagccugaccuucauccgguccacgacgccccuggugauggccuggcgcaccaucauggccgucuucuucguggugacccucaucccccugugccggacgagcugccugcagaagcagucccacugggucgagaucaccgcccucauccugggcgcgcaggcccugcccguguaccucaugacccugaugaagggggccagccgccgguccuggccgcugaacgagggcaucauggccguggggcucgucagccugcugggcuccgcgcuccugaagaacgacgugccccuggccggccccaugguggccgggggccuccugcuggccgccuacgucaugagcggguccagcgcggaccucucccuggagaaggccgccaacgugcagugggacgagauggccgacaucaccggcagcagccccaucaucgaggugaagcaggacgaggacggguccuucagcauccgcgaggucgaggagacgaacaugaucacccugcucgugaagcuggcccugaucaccguguccggccucuacccgcuggcgauccccgucaccauggcccugugguacguguggcaggucaagacgcagcggagcggcgcccucugggacguccccucccccgccgccacccacaaggcgacccugagcgaggggguguaccgcaucaugcagcggggccuguucgggaagacccaggugggcgucgggauccacauggagggcguguuccacaccgugggccacgucacgcgcggguccgugaucugccacgagaccggccggcucgagccgagcuggggcgacgugcgcaacgacaugaucuccuacggcggcggguggcgccugggcgacaagugggacaaggaggaggacguccaggugcuggccaucgagcccgggaagaaccccaagcacgugcagaccaagcccggccucuucaagacccugacgggggagaucggcgccgucacccuggacuucaagccgggcaccagcgggucccccaucaucaacaagaagggcaaggugaucgggcucuacggcaacgggguggucaccaagagcggcgacuacguguccgccaucacgcaggccgagcggaucggcgagcccgacuacgagguggacgaggacaucuuccgcaagaagcggcugaccaucauggaccugcacccgggggcgggcaagaccaagcgcauccuccccagcaucguccgggaggcccugaagcgccggcugcgcacccucauccuggcccccacgcgggugguggccgcggagauggaggaggcccugcgcgggcugcccauccgguaccagaccccggccgucaaguccgagcacaccggccgcgagaucguggaccucaugugccacgccaccuucacgacccggcugcugagcuccacccgcguccccaacuacaaccucaucgugauggacgaggcccacuucaccgaccccugcagcguggcggcccggggguacaucuccacgcgcgucgagaugggcgaggccgccgccaucuucaugaccgcgacgcccccgggcagcaucgaccccuucccccagagcaacucccccaucgaggacaucgagcgggagaucccggagcgcagcuggaacaccggguucgacuggaucacggacuaccagggcaagaccgugugguucgugcccuccaucaaggccgggaacgacaucgccaacugccugcgcaagagcggcaagcgcgucauccagcugucccgcaagaccuucgacaccgaguaccccaagacgaagcucaccgacugggacuucguggugaccaccgacaucagcgagaugggggccaacuuccgggccggccgcgucaucgacccccggcgcugccugaagccggugauccugacggacggccccgagcgggugauccucgcggggcccauccccgucaccccggccuccgccgcccagcgccggggccgcaucgggcggaaccccgcgcaggaggacgaccaguacguguucagcggcgacccccugaagaacgacgaggaccacgcccacuggaccgaggccaagaugcugcucgacaacaucuacacccccgagggcaucaucccgacgcuguucgggcccgagcgcgagaagacccaggccaucgacggcgaguuccggcugcgcggggagcagcggaagaccuucguggagcucaugcgccggggcgaccugcccgucuggcuguccuacaagguggccagcgcggggaucuccuacaaggaccgcgaguggugcuucaccggcgagcggaacaaccagauccucgaggagaacauggagguggagaucuggacgcgcgagggcgagaagaagaagcugcggcccaaguggcuggacgcccgcgucuacgccgacccgauggcccucaaggacuucaaggaguucgccagcgggcggaaguccaucacccuggacauccugaccgagaucgcgacccuccccaccuaccugagcuccaaggccaagcuggcccucgacaacaucgugaugcugcacacgaccgagaagggcgggcgcgccuaccagcacgcccugaacgagcuccccgagagccuggagacccugaugcucguggcgcugcugggcgccaugaccgccgggaucuuccucuucuucaugcagggcaagggcaucgggaagcuguccaugggccugaucgccaucgcggucgccagcgggcuccuguggguggccgagauccagccgcaguggaucgccgccuccaucauccuggaguucuuccucauggugcugcugauccccgagcccgagaagcagcgcacgccccaggacaaccagcucaucuacgucauccugaccauccugaccaucaucggccucaucgcggccaacgagauggggcugaucgagaagaccaagacggacuucggcuucuaccaggugaagccggagaccaccauccuggacguggaccuccggcccgccagcgccuggacccuguacgccgucgcgacgaccauccugacccccaugcuccgccacaccaucgagaacacgagcgccaaccugucccuggccgccaucgccaaccaggcggccgugcucaugggccuggggaagggcuggccccugcaccggauggaccucggggugccgcugcuggccaugggcugcuacagccaggucaaccccaccacccucaccgccucccuggugaugcugcucgugcacuacgccaucaucggccccgggcugcaggcgaaggccacgcgcgaggcccagaagcggaccgccgcgggcaucaugaagaaccccaccgucgacgggaucaccgugaucgaccuggagccgaucagcuacgaccccaaguucgagaagcagcucggccaggugaugcugcugguccucugcguggggcagcugcugcucaugcgcacgaccugggcccugugcgaggugcugacccucgccaccggccccgucaugacgcugugggagggcaaccccgggcgguucuggaacaccaccaucgccguguccaccgccaacaucuuccgcggcagcuaccuggcgggggccggccucgccuucucccugaucaagaacgcccagacgccgcggcgcgggaccggcaccaccggcgagacgcugggggagaaguggaagcggcagcucaacagccuggaccgcaaggaguucgaggaguacaagcgguccggcauccuggagguggaccgcaccgaggccaagagcgcgcuccgggacgggaccaagaucaaguacgccgucucccgcggcagcuccaagauccgguggaucguggagcgcgggaugaucaagcccaagggcaagguggucgaccugggcugcgggcggggcggguggagcuacuacauggccacccugaagaacgugaccgaggugaagggcuacacgaagggcgggcccggccacgaggagcccaucccgauggccaccuacggguggaaccucgucaagcugcacuccggcguggacguguucuacaagcccaccgagcaggucgacacccugcucugcgacaucggggagagcuccagcaaccccacgaucgaggagggccgcacccugcgcgugcugaagauggucgagcccuggcucuccagcaagccggaguucugcaucaaggugcugaaccccuacaugcccaccgugaucgaggagcuggagaagcuccagcggcgccacggcgggagccugguccggugcccccugucccgcaacagcacccacgagauguacuggguguccggcgccagcgggaacaucguguccagcgucaacacgaucuccaagaugcugcucaaccgguucaccacccgccaccggaagccgaccuacgagaaggacguggaccugggcgcggggacgcgcagcguguccaccgagaccgagaagcccgacaugaccgucaucggccggcgccugcagcggcuccgcgaggagcacaaggagacguggcacuacgaccaggagaaccccuaccggaccugggccuaccacggcagcuacgaggccccguccaccgggagcgccuccagcauggugaacggcguggucaagcugcugaccaagcccugggacgugauccccauggugacgcagcucgcgaugaccgacaccacccccuucgggcagcagcgcgucuucaaggagaagguggacacgcggaccccgcagcccaagcccggcacccgcaugaucaugaccacgaccgccaacuggcugugggcccugcucgggaagaagaaguccccgcggcugugcacccgcgaggaguucaucagcaaggugcggagcaacgccgccaucggcgcggucuuccaggaggagcagggcuggaccagcgccuccgaggccgugaacgacagccgcuucugggagcugguggacaaggagcgggcccuccaccaggaggggaagugcgagagcugcgucuacaacaugaugggcaagcgcgagaagaagcugggggaguucggccgcgccaaggggucccgggcgaucugguacauguggcugggcgcccgcuuccucgaguucgaggcccugggcuuccugaacgaggaccacugguucagccgggagaacuccuggagcgggguggagggcgaggggcuccaccgccugggcuacauccuggaggacaucgacaagaaggacggcgaccucaucuacgccgacgacacggccgggugggacacccggaucaccgaggacgaccugcugaacgaggagcucaucaccgagcagauggcgccccaccacaagacgcuggccaaggccaucuucaagcugaccuaccagaacaagguggucaaggugcuccgccccacccccaagggcgccgugauggacaucaucucccggaaggaccagcgcgggagcggccaggucgggaccuacggccugaacaccuucacgaacauggaggugcagcugauccggcagauggaggcggagggcgugaucacccaggacgacaugcagaaccccaaggggcucaaggagcgcgucgagaaguggcugaaggagugcggcguggaccggcugaagcgcauggccaucuccggggacgacugcguggucaagccgcucgacgagcgguucagcaccucccugcuguuccucaacgacaugggcaaggugcgcaaggacaucccccagugggagcccagcaagggguggaagaacuggcaggaggugcccuucugcucccaccacuuccacaagaucuucaugaaggacggccggagccuggucgugccgugccgcaaccaggacgagcugaucggccgggcccgcaucucccagggggccggcuggagccuccgggagaccgccugccuggggaaggcguacgcccagauguggucccugauguacuuccaccgccgcgaccuccggcuggccagcauggccaucugcuccgccgugcccacggagugguuccccaccagccgcaccaccuggagcauccacgcgcaccaccaguggaugacgaccgaggacaugcugaaggucuggaaccggguguggaucgaggacaaccccaacaugaccgacaagaccccggugcacuccugggaggacauccccuaccucggcaagcgcgaggaccuguggugcgggagccugaucggccucuccagccgggccacgugggccaagaacauccacaccgccaucacccagguccgcaaccugaucggcaaggaggaguacguggacuacaugcccgccaugaagcgguacuccgcgcccuucgagagcgagggggugcuguga

SEQ ID NO: 10484 - RNA, 9867 nt, Artificial Sequence
  derived and/or modified CDS sequence (opt1) from DENV-4__JQ822247__SS-prME
agcaccaugacccugcucugccugauccccacggugauggccuuccaccuguccacccgcgacggcgagccgcucaugaucgucgccaagcacgagcgggggcgcccccugcuguucaagaccaccgagggcaucaacaagugcacgcucaucgcgauggaccugggggagaugugcgaggacaccgugaccuacaagugcccccugcucgugaacaccgagcccgaggacaucgacugcuggugcaaccugacgagcaccugggucauguacggcaccugcacccaguccggggagcggcgccgggagaagcgcagcguggcccugacgccgcacuccggcaugggccucgagacccgggccgagaccuggaugagcuccgagggggccuggaagcacgcccagcgcguggagagcuggauccugcggaaccccggcuucgcgcugcucgccggguucauggccuacaugaucggccagaccgggauccagcgcacggucuucuucgugcugaugaugcugguggcccccuccuacggcaugcggugcgucggcguggggaaccgcgacuucguggagggcgucagcgggggcgcguggguggaccucgugcuggagcacggcgggugcgucaccaccauggcccagggcaagcccacccuggacuucgagcucacgaagaccaccgccaaggagguggcccugcugcggaccuacugcaucgaggccuccaucagcaacaucacgaccgcgacccgcugcccgacccagggggagcccuaccucaaggaggagcaggaccagcaguacaucugccggcgcgacguggucgaccggggcugggggaacggcugcggccuguucgggaagggcgggguggugacgugcgccaaguuccugugcuccggcaagaucaccgggaaccucguccagaucgagaaccuggaguacaccgugguggucaccgugcacaacggcaacacgcacgccgucggcaacgacaccagcaaccacggggugaccgccaccaucacgccccgcucccccagcguggaggucaagcugccggacuacggcgagcucacccuggacugcgagccccgguccgggaucgacuucaacgagaugauccugaugaagaugaagaagaagaccuggcucgugcacaagcagugguuccuggaccugccccuccccuggaccgccggcgcggacaccagcgaggugcacuggaacuacaaggagcgcauggucacguucaaggugccgcacgccaagcggcaggacgugaccguccuggggucccaggagggcgccaugcacagcgcccuggccggcgcgaccgagguggacagcggggacggcaaccacauguucgccgggcaccucaagugcaaggugcgcauggagaagcugcgcaucaagggcauguccuacaccaugugcagcggcaaguucuccaucgacaaggagauggccgagacgcagcacgggaccaccgucgugaaggugaaguacgagggcgccggggcccccugcaagguccccaucgagauccgggacgugaacaaggagaagguggucggccgcaucaucagcuccacccccuucgcggagaacacgaacagcgugaccaacaucgagcuggagccgcccuucggggacuccuacaucgugaucggcgucggcgacagcgcccucacccugcacugguuccggaagggguccagcaucggcaagauguucgaguccaccuaccgcggggccaagcggauggccauccugggcgagacggcgugggacuucgggagcgugggcggccucuucaccucccuggggaaggccgugcaccaggucuucggcagcguguacaccaccauguucgggggcguguccuggaugauccgcauccugaucggguuccucguccuguggaucggcacgaacagccggaacaccuccauggccaugaccugcaucgccgugggcgggaucacccuguuccugggcuucacggugcaggccgacauggggugcgucgugagcuggaacggcaaggagcucaagugcggguccggcaucuucguggucgacaacgugcacaccuggaccgagcaguacaaguuccagcccgagagccccgcgcgccuggccagcgccauccugaacgcccacaaggacggcgugugcgggauccgguccaccacgcgccucgagaacgucauguggaagcagaucaccaacgagcugaacuacgugcugugggagggcgggcacgaccucaccguggucgccggcgacgugaagggcgugcugaccaaggggaagcgggcgcugacgccgcccgucaacgaccucaaguacagcuggaagaccuggggcaaggccaagaucuucacccccgaggcccgcaacuccaccuuccugaucgacgggcccgacacgagcgagugcccgaacgagcggcgcgccuggaacuucuucgagguggaggacuacggcuucgggauguucaccaccaacaucuggaugaaguuccgggagggcuccagcgaggugugcgaccaccgccugauguccgccgcgaucaaggaccagaaggccguccacgccgacaugggcuacuggaucgagagcuccaagaaccagaccuggcagaucgagaaggccagccucaucgaggugaagacgugccuguggcccaagacccacacccugugguccaacggggugcucgagagccagaugcugaucccccgguccuacgcgggcccguucagccagcacaacuaccgccagggguacgccacccagaccgccggccccuggcaccuggggaagcucgagaucgacuucggcgagugccccggcacgaccgucaccauccaggaggacugcgaccaccgggggcccucccugcgcaccacgaccgccagcggcaagcuggugacccaguggugcugccgcuccugcaccaugccgccccuccgguuccugggggaggacggcugcugguacgggauggagauccgcccccugagcgagaaggaggagaacauggugaagagccaggucacggccggccagggcaccuccgagaccuucagcauggggcuccugugccugacccucuucguggaggagugccugcggcgccgggucacgcgcaagcacaugauccuggcgguggugaucaccuucugcgccaucauccucggcgggcugaccuggauggaccugcuccggguccugaucaugcugggcgacaccauguccggccgcaucgggggccagauccaccucgccaucauggccguguucaagaugagccccggguacgugcugggcgucuuccugcggaagcucacgucccgcgagaccgcccugauggugaucgggauggcgaugaccaccguguucagcaucccgcacgaccugauggagcucaucgacggcaucucccugggccugauccuccugaagaucgucacgcacuucgacaacacccagguggggacccuggcccucagccugaccuucauccgguccacgaccccccuggugauggccuggcgcaccaucauggccgucuucuucguggugacccucaucccccugugccggacgagcugccugcagaagcagucccacugggucgagaucaccgcccucauccugggcgcgcaggcccugcccguguaccucaugacccugaugaagggggccagccgccgguccuggccgcugaacgagggcaucauggccguggggcucgucagccugcugggcuccgcgcuccugaagaacgacgugccccuggccggccccaugguggccgggggccuccugcuggccgccuacgucaugagcggguccagcgcggaccucucccuggagaaggccgccaacgugcagugggacgagauggccgacaucaccggcagcagccccaucaucgaggugaagcaggacgaggacggguccuucagcauccgcgacgucgaggagacgaacaugaucacccugcucgugaagcuggcccugaucaccguguccggccucuacccgcuggcgauccccgucaccauggcccugugguacguguggcaggugaagacgcagcggagcggcgcccucugggacguccccucccccgccgccacccagaaggcgacccugagcgaggggguguaccgcaucaugcagcggggccuguucgggaagacccaggugggcgucgggauccacauggagggcguguuccacaccauguggcacgugacgcgcggcuccgucaucugccacgagaccgggcggcucgagccgagcugggccgacgugcgcaacgacaugaucuccuacggcgggggcuggcgccugggcgacaagugggacaaggaggaggacgugcagguccuggccaucgagcccgggaagaaccccaagcacgugcagaccaagcccggccucuucaagacccugacgggggagaucggcgccgugacccuggacuucaagccggggaccagcggcucccccaucaucaacaagaagggcaaggucaucgggcucuacggcaacgggguggugaccaagagcggcgacuacgucuccgccaucacgcaggcggagcggaucggggagcccgacuacgagguggacgaggacaucuuccgcaagaagcggcugaccaucauggaccugcacccgggcgccggcaagaccaagcgcauccuccccagcaucgugcgggaggcccugaagcgccggcugcgcacccucauccuggcccccacgcgggucguggcggccgagauggaggaggcccugcgcgggcugcccauccgguaccagaccccggccgugaaguccgagcacaccggccgcgagaucgucgaccucaugugccacgccaccuucacgacccggcugcugagcuccacccgcgugcccaacuacaaccucaucgucauggacgaggcgcacuucaccgaccccugcagcguggccgcccggggguacaucuccacgcgcguggagaugggcgaggccgccgcgaucuucaugaccgccacccccccggggagcaucgaccccuucccccagagcaacucccccaucgaggacaucgagcgggagaucccggagcgcagcuggaacaccggcuucgacuggaucacggacuaccagggcaagaccgucugguucgugcccuccaucaaggccgggaacgacaucgccaacugccugcggaagagcggcaagcgcgugauccagcugucccgcaagaccuucgacaccgaguaccccaagacgaagcucaccgacugggacuucgucgugaccaccgacaucagcgagaugggggccaacuuccgggcgggccgcgugaucgacccccggcgcugccugaagccggucauccugacggacgggcccgagcgggugauccucgccggccccauccccgugaccccggccuccgccgcgcagcgccggggccgcaucgggcggaaccccgcccaggaggacgaccaguacgucuucagcggcgacccccugaagaacgacgaggaccacgcccacuggaccgaggccaagaugcugcucgacaacaucuacacccccgaggggaucaucccgacgcuguucggccccgagcgcgagaagacccaggccaucgacggcgaguuccggcugcgcggggagcagcggaagaccuucguggagcucaugcgccggggcgaccugcccguguggcuguccuacaaggucgcgagcgccgggaucuccuacaaggaccgcgaguggugcuucaccggcgagcggaacaaccagauccucgaggagaacauggagguggagaucuggacgcgcgagggggagaagaagaagcugcggcccaaguggcuggacgcccgcguguacgccgacccgauggcccucaaggacuucaaggaguucgcgagcggccggaaguccaucacccuggacauccugaccgagaucgccacccuccccaccuaccugagcuccaaggccaagcuggcccucgacaacaucgucaugcugcacacgaccgagaagggcgggcgcgccuaccagcacgcgcugaacgagcuccccgagagccuggagacccugaugcucguggcccugcugggcgccaugaccgccgggaucuuccucuucuucaugcagggcaaggggaucggcaagcuguccaugggccugaucgcgaucgccguggccagcgggcuccugugggucgccgagauccagccgcaguggaucgccgcguccaucauccuggaguucuuccucauggugcugcugauccccgagcccgagaagcagcgcacgccccaggacaaccagcucaucuacgugauccugaccauccugaccaucaucggccucaucgccgccaacgagauggggcugaucgagaagaccaagacggacuucggcuucuaccaggucaagccggagaccaccauccuggacguggaccuccggcccgccagcgccuggacccuguacgcgguggccacgaccauccugacccccaugcuccgccacaccaucgagaacacgagcgccaaccugucccuggccgccaucgcgaaccaggccgccguccucauggggcugggcaagggcuggccccugcaccggauggaccucggggugccgcugcuggccaugggcugcuacagccaggugaaccccaccacccucaccgccucccuggucaugcugcucgugcacuacgcgaucaucgggcccggccugcaggccaaggccacgcgcgaggcccagaagcggaccgcggccggcaucaugaagaaccccaccguggacgggaucaccgucaucgaccuggagccgaucagcuacgaccccaaguucgagaagcagcucggccaggugaugcugcuggugcucugcgucgggcagcugcugcucaugcgcacgaccugggcccugugcgaggugcugacccucgccaccggccccgugaugacgcugugggaggggaaccccggccgguucuggaacaccaccaucgccgucuccaccgcgaacaucuuccgcggcagcuaccuggccggggccggccucgccuucucccugaucaagaacgcccagacgccgcggcgcgggaccggcaccaccggggagacgcugggcgagaaguggaagcggcagcucaacagccuggaccgcaaggaguucgaggaguacaagcgguccggcauccuggagguggaccgcaccgaggcgaagagcgcccuccgggacgggaccaagaucaaguacgccgugucccgcggcagcuccaagauccgguggaucgucgagcgcgggaugaucaagcccaagggcaaggugguggaccuggggugcggccggggcggguggagcuacuacauggccacccugaagaacgucaccgaggugaagggcuacacgaaggggggccccgggcacgaggagcccaucccgauggccaccuacggcuggaaccucgugaagcugcacuccggcgucgacguguucuacaagcccaccgagcagguggacacccugcucugcgacaucggggagagcuccagcaaccccacgaucgaggagggccgcacccugcgcguccugaagaugguggagcccuggcucuccagcaagccggaguucugcaucaagguccugaaccccuacaugcccaccgugaucgaggagcuggagaagcuccagcggcgccacgggggcagccuggugcggugcccccugucccgcaacagcacccacgagauguacugggucuccggcgcgagcgggaacaucguguccagcgugaacacgaucuccaagaugcugcucaaccgguucaccacccgccaccggaagccgaccuacgagaaggacgucgaccugggcgccgggacgcgcagcguguccaccgagaccgagaagcccgacaugaccgugaucggccggcgccugcagcggcuccgcgaggagcacaaggagacguggcacuacgaccaggagaaccccuaccggaccugggccuaccacgggagcuacgaggccccguccaccggcagcgcguccagcauggucaacggcguggugaagcugcugaccaagcccugggacgucauccccauggugacgcagcucgccaugaccgacaccacccccuucgggcagcagcgcguguucaaggagaaggucgacacgcggaccccgcagcccaagcccggcacccgcaugaucaugaccacgaccgccaacuggcugugggcccugcucgggaagaagaaguccccccggcugugcacccgcgaggaguucaucagcaaggugcgguccaacgccgcgaucggcgccguguuccaggaggagcagggguggaccagcgccuccgaggccgucaacgacagccgcuucugggagcugguggacaaggagcgggcccuccaccaggagggcaagugcgagagcugcguguacaacaugaugggcaagcgcgagaagaagcugggggaguucggccgcgcgaaggggucccgggccaucugguacauguggcugggcgcccgcuuccucgaguucgaggcccugggguuccugaacgaggaccacugguucagccgggagaacuccuggagcggcgucgagggcgaggggcuccaccgccugggcuacauccuggaggacaucgacaagaaggacggggaccucaucuacgccgacgacacggcgggcugggacacccggaucaccgaggacgaccugcugaacgaggagcucaucaccgagcagauggccccgcaccacaagacgcuggccaaggccaucuucaagcugaccuaccagaacaagguggugaagguccuccgccccacccccaagggcgcggugauggacaucaucucccggaaggaccagcgcgggagcggccagguggggaccuacggccugaacaccuucacgaacauggagguccagcugauccggcagauggaggccgagggggugaucacccaggacgacaugcagaaccccaagggccucaaggagcgcguggagaaguggcugaaggagugcggcgucgaccggcugaagcgcauggccaucuccggggacgacugcguggugaagccgcucgacgagcgguucagcaccucccugcuguuccucaacgacaugggcaagguccgcaaggacaucccccagugggagcccagcaagggguggaagaacuggcaggaggugcccuucugcucccaccacuuccacaagaucuucaugaaggacggccggagccugguggucccgugccgcaaccaggacgagcugaucgggcgggcccgcaucucccagggcgccggcuggagccuccgggagaccgcgugccuggggaaggccuacgcccagauguggucccugauguacuuccaccgccgcgaccuccggcuggccagcauggccaucugcuccgcggugcccacggagugguuccccaccagccgcaccaccuggagcauccacgcccaccaccaguggaugacgaccgaggacaugcugaagguguggaaccgggucuggaucgaggacaaccccaacaugaccgacaagaccccggugcacuccugggaggacauccccuaccucggcaagcgcgaggaccuguggugcgggagccugaucggccucuccagccgggccacgugggccaagaacauccacaccgccaucacccaggugcgcaaccugaucgggaaggaggaguacgucgacuacaugcccgcgaugaagcgguacuccgcccccuucgagagcgagggcgugcuguga

SEQ ID NO: 10485 - RNA, 9867 nt, Artificial Sequence
  derived and/or modified CDS sequence (opt1) from DENV-4__JF262783__SS-prME
agcaccgugacccugcucugccugauccccaccgugauggccuuccaccugagcacccgcgacggcgagccgcucaugaucguggccaagcacgagcgggggcgcccccugcuguucaagaccaccgagggcaucaacaagugcacccucaucgccauggaccugggggagaugugcgaggacaccgugauguacaagugcccccugcucgugaacaccgagcccgaggacaucgacugcuggugcaaccugaccagcaccugggugauguacgggaccugcacccaguccggggagcggcgccgggagaagcgcagcguggcccugaccccgcacuccggcaugggccucgagacgcgggccgagaccuggaugagcuccgagggggccuggaagcacgcccagcgcguggagagcuggauccugcggaaccccggcuucgcgcugcucgccggguucauggccuacaugaucggccagaccgggauccagcgcaccguguucuucgugcugaugaugcuggucgcccccuccuacggcaugcggugcgugggcguggggaaccgcgacuucgucgagggcgugagcgggggcgcguggguggaccucguccuggagcacggcgggugcgugacgaccauggcccagggcaagcccacccuggacuucgagcucaucaagaccacggccaaggaggugacccugcugcggaccuacugcaucgaggccuccaucagcaacaucaccacggccacccgcugcccgacccagggggagcccuaccucaaggaggagcaggaccagcaguacaucugccggcgcgacgucguggaccggggcugggggaacggcugcggccuguucgggaagggcgggguggugaccugcgcgaaguuccugugcuccggcaagaucacggggaaccucgugcagaucgagaaccuggaguacaccguggucgugaccguccacaacggcgacacccacguggugggcaaggacacgagcaaccacggggucaccgccaccaucacgccccgcucccccagcguggaggugaagcugccggacuacggcgagcucacgcuggacugcgagccccgguccgggaucgacuucaacgagaugauccugaugaagaugaagaagaagaccuggcucguccacaagcagugguuccuggaccugccccuccccuggaccgccggcgccgacaccagcgaggugcaguggaacuacaaggagcgcauggugaccuucaaggucccgcacgccaagcggcaggacgugacggugcuggggucccaggagggcgcgaugcacagcgcccugaccggcgccaccgaggucgacagcggggacggcaaccacauguucgccgggcaccucaagugcaaggugcgcauggagaagcugcgcaucaagggcauguccuacaccaugugcagcggcaaguucuccaucgacaaggagauggccgagacgcagcacgggaccaccguggucaaggugaaguacgagggcgcgggggcccccugcaaggugcccaucgagauccgggacgucaacaaggagaagguggugggccgcaucaucagcuccacccccuucgccgagaacacgaacagcgucaccaacaucgagcuggagccgcccuucggggacuccuacaucgugaucggcgugggcgacagcgcccucacccugcacugguuccggaagggguccagcaucggcaagauguucgaguccaccuaccgcggggccaagcggauggcgauccugggcgagacggccugggacuucgggagcgucggcggccucuucaccucccuggggaaggccgugcaccagguguucggcagcgucuacaccaccauguucgggggcguguccuggauggugcgcauccugaucgggcuccugguccuguggaucggcacgaacagccggaacaccuccauggccaugaccugcaucgcgaucggcgggaucacccuguuccucggcuucacggugcacgccgacauggggugcgccgugagcugguccggcaaggagcugaagugcgggagcggcaucuucgucaucgacaacgugcacaccuggaccgagcaguacaaguuccagcccgagagccccgcccgccuggccuccgcgauccucaacgcccacaaggacggcgugugcgggauccggagcaccacgcgccuggagaacgucauguggaagcagaucaccaacgagcugaacuacgugcucugggagggcgggcacgaccugaccguggucgccggcgacgugaagggcgugcugaccaaggggaagcgggcccucacgccgcccgucaacgaccugaaguacuccuggaagaccuggggcaaggccaagaucuucacccccgaggcgcgcaacagcaccuuccugaucgacgggcccgacacguccgagugcccgaacgagcggcgcgccuggaacuuccucgagguggaggacuacggcuucgggauguucgccaccaacaucuggaugaaguuccgggagggcagcuccgaggugugcgaccaccgccugaugagcgccgccaucaaggaccagaaggcgguccacgccgacaugggcuacuggaucgaguccagcaagaaccagaccuggcagaucgagaaggccucccugaucgaggugaagaccugccucuggcccaagacgcacacccuguggagcaacgaggugcuggagucccagaugcucauccccaaggccuacgcggggccguucagccagcacaacuaccggcagggcuacgccacccagaccaucgggcccuggcaccugggcaagcuggagaucgacuucggggagugccccggcaccacggucaccauccaggaggacugcaaccaccgcggccccucccuccggaccaccacggccagcgggaagcuggugacccaguggugcugccgcuccugcaccaugccgccccugcgcuuccucggcgaggacgggugcugguacggcauggagauccggccccugagcgagaaggaggagaacauggucaagagccaggucuccgccgggcagggcaccagcgagacguucuccaugggccugcucugccugacccuguucguggaggagugccuccgccggcgcgucacccggaagcacaugauccuggugguggucaccacgcugugcgccaucauccucgggggccugaccuggauggaccugcuccgcgcgcugaucaugcugggggacaccaugagcggccggaugggcgggcagauccaccucaccaucauggccguguucaagaugucccccggcuacgugcugggggucuuccugcgcaagcucacgagccgggagaccgcccugaucgugaucggcauggccaugaccaccgugcuguccaucccgcacgaccucauggaguucaucgacgggaucagccugggccugauccuccugaagauggucgcccacuucgacaacacccaggugggcacccuggcgcucucccugaccuucauccgcagcaccaugccccuggugauggccuggcggacgaucauggccguccucuucguggugacccugaucccccugugccgcaccuccugccuccagaagcagagccacugggucgagaucaccgcccugauccugggggcccaggcgcuccccguguaccugaugacgcugaugaagggcgccuccaagcggagcuggccgcucaacgaggggaucauggccgugggccuggucucccugcucgggagcgcccugcugaagaacgacgugccccucgcgggccccaugguggccggcgggcugcugcucgccgccuacgucauguccggcagcuccgccgaccugagccuggagaaggcggccaacgugcagugggacgagauggccgacaucaccgggagcucccccaucaucgaggugaagcaggacgaggacggcagcuucuccauccgcgacgucgaggagaccaacaugaucacccuccuggugaagcuggcccucaucacggugagcgggcuguacccgcuggccauccccgucaccauggcgcucugguacauguggcaggucaagacccagcgguccggcgcccugugggacgugcccagccccgccgccgcccagaaggcgacccugacggagggcgucuaccgcaucaugcagcggggccucuucggcaagacccaggugggggugggcauccacauggagggggucuuccacaccauguggcacgugacccgcggcuccgugaucugccacgagaccggccggcuggagccgagcugggccgacguccgcaacgacaugaucuccuacgggggcggguggcggcugggcgacaagugggacaaggaggaggacguccaggugcucgccaucgagcccggcaagaaccccaagcacguccagacgaagcccgggcuguucaagacccugaccggcgagaucggggccgugacccucgacuucaagccgggcacgagcgggucccccaucaucaacaagaagggccgcgugaucggccuguacgggaacggcaucgucaccaagagcggggacuacguguccgccaucacccaggcggagcgcaucggcgagcccgacuacgagguggacgaggacaucuuccggaagaagcgccugaccgucauggaccuccacccgggggccggcaagacgaagcggauccugcccagcaucgugcgcgaggcccugaagcggcgccugcggacccucauccuggcccccacccgcguggucgcggccgagauggaggaggcccugcggggccuccccauccgcuaccagaccccggccgugaaguccgagcacacggggcgggagaucguggaccugaugugccacgccaccuucaccacccgccugcucagcuccacgcggguccccaacuacaaccugaucgugauggacgaggcgcacuucaccgaccccagcuccgucgccgcccgcggcuacaucagcacccggguggagaugggggaggccgccgcgaucuucaugaccgccacgcccccgggcgccaccgaccccuucccccagagcaacucccccaucgaggacaucgagcgcgagaucccggagcggagcuggaacaccggguucgacuggaucaccgacuaccagggcaagacggugugguucguccccuccaucaaggccggcaacgacaucgccaacugccugcgcaagagcgggaagaaggugauccagcucucccggaagaccuucgacaccgaguaccccaagaccaagcugacggacugggacuucguggucaccaccgacaucagcgagaugggcgcgaacuuccgcgcccgccgggugaucgacccccgccggugccugaagccggugauccucaccgacgggcccgagcgcgucauccuggccggccccauccccgugacgccggccuccgcggcccagcggcgcgggcggaucggccgcaaccccgcccaggaggacgaccaguacguguucagcggcgacccccugaagaacgacgaggaccacgcccacuggaccgaggccaagaugcuccuggacaacaucuacacccccgaggggaucaucccgacccuguucggccccgagcgggagaagauccaggcgaucgacggggaguuccgccuccggggcgagcagcgcaagacguucgucgagcugaugcggcgcggcgaccugcccguguggcucuccuacaagguggccagcgccgggaucuccuacaaggaccgggaguggugcuucaccggcgagcgcaacaaccagauccuggaggagaacauggaggucgagaucuggacccgggagggggagaagaagaagcugcgccccaaguggcucgacgcccggguguacgccgacccgauggcgcugaaggacuucaaggaguucgccagcggccgcaaguccaucacccuggacauccucacggagaucgccagccugcccaccuaccuguccagccgggccaagcucgcccuggacaacaucgugaugcugcacaccaccgagcgcgggggccgcgcguaccagcacgcccucaacgagcugcccgagucccuggagacccucaugcuggucgcccugcucggcgccaugacggcggggaucuuccuguucuucaugcagggcaaggggaucggcaagcugagcauggggcucauggccaucgccguggccuccggccugcuguggguggccgagauccagccgcaguggaucgcggccagcaucauccucgaguucuuccugauggcccugcucauccccgagcccgagaagcagcggacgccccaggacaaccagcugaucuacgucauccugaccauccucaccaucaucggccugaucgccgccaacgagauggggcugaucgagaagacgaagaccgacuucggcuucuaccaggugaagaccgagaccacgauccucgacguggaccugcgcccggcgagcgccuggacccuguacgccgucgccaccaccauccucacgcccaugcugcggcacaccaucgagaacaccuccgccaaccugagccucgcggccaucgccaaccaggccgccgugcugauggggcugggcaagggguggccccuccaccgcauggaccugggcgugccccugcucgcgaugggcugcuacucccaggucaacccgaccacgcugaccgccagccuggugaugcucuccgugcacuacgccaucaucgggcccggccugcaggccaaggcgacccgggaggcccagaagcgcaccgccgccgggaucaugaagaaccccacggucgacggcaucaccgugaucgaccuggagcccaucagcuacgacccgaaguucgagaagcagcucggccaggugaugcugcuggcccucugcgcggggcagcugcugcucaugcggaccaccugggccuucugcgagguccugacgcuggccaccggccccauccucacccugugggaggggaaccccggccgcuucuggaacaccacgaucgccguguccaccgccaacaucuuccgggggagcuaccuggcgggcgccggccucgccuucucccugaucaagaacgcccagacgccccggcgggggaccggcacgaccggggagacccugggcgagaaguggaagcgccagcucaacagccuggaccggaaggaguucgaggaguacaagcgcuccgggauccuggagguggaccggaccgaggccaagagcgcgcucaaggacggcuccaagaucaagcacgccgucagccgcggcuccagcaagauccgguggaucguggagcgcgggauggugaagccgaagggcaaggucguggaccuggggugcggccgcggcgggugguccuacuacauggccacgcugaagaacgugaccgaggucaagggguacaccaagggcgggcccgggcacgaggagcccauccccauggccaccuacggcuggaaccucgugaagcugcacagcgggguggacgucuucuacaagccgaccgagcaggucgacacgcugcucugcgacaucggcgaguccagcagcaaccccaccaucgaggagggccgcacccugcgcgugcugaagauggucgagcccuggcucuccagcaagcccgaguucugcaucaaggugcugaacccguacaugcccaccgugaucgaggagcuggagaagcugcagcggaagcacgggggcucccucguccgcugcccccugagccggaacuccacgcacgagauguacugggugagcggggcguccggcaacaucgucagcuccgugaacaccaccagcaagaugcugcucaaccgcuucaccacgcggcaccgcaagcccaccuacgagaaggacgugaaccugggcgccgggacccgguccgucagcaccgagacggagaagccggacaugaccaucaucggccgccggcugcagcgccuccgggaggagcacaaggagaccuggcacuacgaccaggagaaccccuaccgcaccugggccuaccacggguccuacgaggcccccagcacgggcuccgccagcuccauggugaacgggguggucaagcugcugaccaagccgugggacgugauccccauggugacccagcucgcgaugaccgacacgacccccuucggccagcagcgggucuucaaggagaagguggacacccgcacgccccagccgaagcccggcacgcggauggugaugaccaccaccgccaacuggcugugggcccugcucgggaagaagaaguccccgcgccugugcacgcgggaggaguucaucuccaagguccgcagcaacgccgccaucggcgcgguguuccaggaggagcagggguggaccagcgccuccgaggccgugaacgacagccgguucugggagcuggucgacaaggagcgcgcccuccaccaggagggcaagugcgaguccugcguguacaacaugauggggaagcgggagaagaagcugggcgaguucggccgcgccaaggggagccgcgcgaucugguacauguggcugggcgcccgguuccucgaguucgaggcccugggguuccugaacgaggaccacugguucggccgcgagaacuccuggagcgggguggagggcgagggccuccaccggcugggguacauccuggaggacaucgacaagaaggacggcgaccucaucuacgccgacgacaccgcggggugggacacccgcaucacggaggacgaccugcugaacgaggagcucaucaccgagcagauggcgccccaccaccggauccuggccaaggccaucuucaagcugaccuaccagaacaaggucgugaaggugcuccgccccacccccaagggcgccgucauggacaucaucucccggaaggaccagcgcggcagcggccaggugggcacguacgggcugaacaccuucaccaacauggaggugcagcugauccggcagauggaggcggagggcgucaucacccaggacgacaugcagaaccccaaggggcucaaggagcgcguggagaaguggcugaaggagugcggcguggaccggcugaagcgcauggccaucuccggcgacgacugcgucgugaagccccucgacgagcgguucagcaccucccugcuguuccucaacgacauggggaaggugcgcaaggacaucccgcagugggagcccagcaagggcuggaagaacuggcaggagguccccuucugcucccaccacuuccacaagaucuucaugaaggacgggcggagccugguggugcccugccgcaaccaggacgagcugaucggccgggcccgcaucucccagggggccggcuggagccuccgggagacggccugccugggcaaggcguacgcccagauguggucccugauguacuuccaccgccgcgaccuccggcuggccagcauggccaucugcagcgccgucccgaccgagugguuccccaccucccgcaccacguggagcauccacgcgcaccaccaguggaugaccaccgaggacaugcugaagguguggaaccggguguggaucgaggacaaccccaacaugaccgacaagacgcccguccacuccugggaggacaucccguaccucgggaagcgcgaggaccuguggugcggcagccugaucgggcucuccagccgggccaccugggccaagaacauccacaccgccaucacccaggugcgcaaccugaucggcaaggaggaguacguggacuacaugcccgucaugaagcgguacuccgcccccuucgagagcgagggggugcuguga

SEQ ID NO: 10486 - RNA, 9867 nt, Artificial Sequence
  derived and/or modified CDS sequence (opt1) from DENV-4__KU513441__SS-prME
agcaccaucacccugcucugccugauccccacggugauggccuuccaccuguccacccgcgacggcgagccgcucaugaucgucgccaagcacgagcgggggcgcccccugcuguucaagaccaccgagggcaucaacaagugcacgcucaucgcgauggaccugggggagaugugcgaggacaccgugaccuacaagugcccccugcucgugaacaccgagcccgaggacaucgacugcuggugcaaccugacgagcaccugggucauguacggcaccugcacccaguccggggagcggcgccgggagaagcgcagcguggcccugacgccgcacuccggcaugggccucgagacccgggccgagaccuggaugagcuccgagggggccuggaagcacgcccagcgcguggagagcuggauccugcggaaccccggcuucgcgcugcucgccggguucauggccuacaugaucggccagaccgggauccagcgcacggucuucuucgugcugaugaugcugguggcccccuccuacggcaugcggugcgucggcguggggaaccgcgacuucguggagggcgucagcgggggcgcguggguggaccucgugcuggagcacggcgggugcgucaccaccauggcccagggcaagcccacccuggacuucgagcucacgaagaccaccgccaaggagguggcccugcugcggaccuacugcaucgaggcccucaucuccaacaucacgaccgcgacccgcugcccgacccagggggagcccuaccugaaggaggagcaggaccagcaguacaucugccggcgcgacguggucgaccggggcugggggaacggcugcggccuguucgggaagggcgggguggugacgugcgccaaguucagcugcuccggcaagaucaccgggaaccucguccagaucgagaaccuggaguacaccgugguggucaccgugcacaacggcgacacgcacgccgucggcaacgacaccagcaaccacggggugaccgccaccaucacgccccgcucccccagcguggaggucaagcugccggacuacggcgagcucacccuggacugcgagccccgguccgggaucgacuucaacgagaugauccugaugaagaugaagaagaagaccuggcucgugcacaagcagugguuccuggaccugccccuccccuggaccaccggcgccgacacgagcgaggugcacuggaacuacaaggagcgcauggucaccuucaaggugccgcacgcgaagcggcaggacgugaccguccuggggucccaggagggcgccaugcacagcgcccuggccggcgccaccgagguggacagcggggacggcaaccacauguucgcggggcaccucaagugcaaggugcgcauggagaagcugcgcaucaagggcauguccuacacgaugugcagcggcaaguucuccaucgacaaggagauggccgagacccagcacgggaccaccgucgugaaggugaaguacgagggcgccggggcccccugcaagguccccaucgagauccgggacgugaacaaggagcgcguggucggccgggugaucagcgccacgccccuggcggagaacaccaacuccgugaccaacaucgagcucgagccgcccuucggggacagcuacaucgucaucggcgugggcaacuccgcccugacccugcacugguuccgcaaggggagcuccaucggcaagauguucgagagcacguaccggggggccaagcgcauggccauccucggcgagaccgcgugggacuucggguccgugggcggccuguucaccagccuggggaaggccguccaccagguguucggcuccguguacaccacgauguucgggggcgucagcuggaugauccggauccucaucggguuccuggugcuguggaucggcaccaacucccgcaacaccagcauggccaugaccugcaucgccgugggcgggaucacgcuguuccucggcuucaccguccaggccgacauggggugcgugguguccuggagcggccgggagcugaagugcggguccggcaucuucgucguggacaacgugcacaccuggaccgagcaguacaaguuccagcccgagagccccgcgcgccuggccagcgccauccucaacgcccacaaggacggcgucugcgggauccgguccacgacccgccuggagaacgugauguggaagcagaucaccaacgagcugaacuacgugcucugggagggcgggcacgaccugaccgucguggccggcgacgugaagggcguccugacgaaggggaagcgggcgcucaccccgcccgccagcgaccugaaguacuccuggaagaccuggggcaaggccaagaucuucacccccgaggcccgcaacagcacguuccugaucgacgggcccgacaccuccgagugcccgaacgagcggcgcgccuggaacagcuucgagguggaggacuacggcuucgggauguucaccaccaacaucuggaugaaguuccgggagggcuccagcgaggugugcgaccaccgccucauguccgcggccaucaaggaccagaaggccguccacgccgacaugggcuacuggaucgagagcuccaagaaccagacguggcagaucgagcgggcgagccugaucgaggugaagaccugccuguggcccaagacccacacccucugguccaacggggugcuggagagccagaugcugauccccaaguccuacgccggcccguucagccagcacaacuaccgccagggguacgccacccagacggucggccccuggcaccucgggaagcuggagaucgacuucggcgagugccccggcaccaccgugaccauccaggagaacugcgaccaccgcgggcccucccugcggacgaccaccgccagcggcaagcucgugacccaguggugcugccgcagcugcacgaugccgccccugcgguuccugggggaggacggcugcugguacgggauggagauccgcccccucuccgagaaggaggagaacauggucaagagccaggugaccgccggccagggcaccuccgagaccuucagcauggggcugcugugccucacgcuguucgucgaggagugccugcggcgccgggugacccgcaagcacaugauccucgcgguggucaucacccugugcgccaucauccugggcgggcucaccuggauggaccugcugcgggcccucaucaugcugggcgacacgauguccggccgcaucgggggccagacccaccuggccaucaucgccguguucaagaugagccccggguacgugcucggcgucuuccugcggaagcugaccucccgcgagaccgcgcucauggugaucgggauggccaugacgaccacccugagcaucccgcacgaccugauggagcucaucgacggcaucucccugggccugauccuccugaagaucgugacccaguucgacaacacgcaggucgggacccuggcccucagccugaccuucauccgguccaccaugagccuggugauggccuggcgcacgaucauggccgugcucuucgucgugacccugaucccccugugccggaccuccugccuccagaagcagagccacuggguggagaucaccgcgcugauccugggcgcccaggcccuccccgucuaccugaugacgcugaugaagggggccucccgccggagcuggccccucaacgagggcaucauggcgguggggcuggugucccugcucggcagcgcccugcugaagaacgacgucccgcucgccggccccaugguggccgggggccugcugcucgccgcguacgugauguccgggagcagcgccgaccugucccuggagaaggccgccaacguccagugggacgagauggccgacaucaccggcagcucccccaucaucgaggugaagcaggacgaggacgggagcuucuccauccgcgacguggaggagaccaacaugaucacccuccuggucaagcuggcgcucaucacggugagcggccuguacccccuggccaucccgaucaccaugacccucugguacauguggcaggugaagacccagcgguccggcgcccugugggacguccccagccccgccgccacccagaaggcggcccuguccgaggggguguaccgcaucaugcagcggggccucuucgggaagacgcaggugggcgucgggauccacauggagggcguguuccacaccauguggcacgugacccgcggcagcgucaucugccacgagaccgggcgccuggagcccuccugggccgacgugcggaacgacaugaucagcuacggcgggggcuggcgccugggcgacaagugggacaaggaggaggacgugcagguccucgccaucgagccggggaagaaccccaagcacgugcagacgaagcccggccuguucaagacccugaccggggagaucggcgccgugacccucgacuucaagcccgggacguccggcagcccgaucaucaaccggaagggcaaggucaucgggcuguacggcaacgggguggugaccaaguccggcgacuacgucagcgcgaucacccaggccgagcgcaucggggagcccgacuacgagguggacgaggacaucuuccggaagaagcgccugaccaucauggaccuccaccccggcgccggcaagacgaagcggauccugccguccaucgugcgcgaggcccugaagcggcgccugcggacccucauccuggcgcccacccgcgucguggccgccgagauggaggaggcccugcgggggcuccccauccgcuaccagacccccgccgugaagagcgagcacacgggccgggagaucgucgaccugaugugccacgcgaccuucaccacccgccugcucuccagcacgcgggugccgaacuacaaccugaucgugauggacgaggcccacuucaccgaccccagcuccgucgccgcccgcggguacaucagcacccggguggagaugggcgaggccgcggccaucuucaugaccgccacgccccccggggccaccgacccguucccccaguccaacagccccaucgaggacaucgagcgcgagauccccgagcgcuccuggaacaccggcuucgacuggaucaccgacuaccagggcaagacggucugguucgugccgagcaucaaggccgggaacgacaucgcgaacugccugcggaaguccggcaagaaggugauccagcucagccgcaagaccuucgacaccgaguaccccaagaccaagcugacggacugggacuucgucgugaccaccgacaucuccgagaugggggccaacuuccgggccggccgcgugaucgacccccggcgcugccugaagcccgucauccucaccgacgggccggagcgggugauccuggccggccccauccccgugacgcccgcgagcgccgcccagcgccggggccgcaucgggcggaacccggcccaggaggacgaccaguacgucuucuccggcgacccccugaagaacgacgaggaccacgcccacuggaccgaggcgaagaugcuccuggacaacaucuacacccccgaggggaucauccccacccuguucggcccggagcgcgagaagacgcaggccaucgacggcgaguuccggcuccgcggggagcagcggaagaccuucguggagcugaugcgccggggcgaccugcccguguggcucagcuacaaggucgccuccgccgggaucagcuacaaggaccgcgaguggugcuucaccggcgagcggaacaaccagauccuggaggagaacauggagguggagaucuggacccgcgagggggagaagaagaagcugcggcccaaguggcucgacgcccgcguguacgcggaccccauggcccugaaggacuucaaggaguucgccuccggccgcaagagcaucacccuggacauccucacggagaucgccucccugccgaccuaccugagcucccgggccaagcucgcgcuggacaacaucgucaugcugcacaccaccgagcgcggcgggcgggccuaccagcacgcccucaacgagcugcccgagagccuggagacgcucaugcugguggcccugcucggcgcgaugaccgccgggaucuuccuguucuucaugcagggcaaggggaucggcaagcugagcaugggccucaucaccaucgccguggccuccgggcugcugugggucgccgagauccagccccaguggaucgcggccagcaucauccucgaguucuuccugauggugcugcucaucccggagcccgagaagcagcgcaccccccaggacaaccagcugaucuacgugauccugacgauccucaccaucaucggccugaucgccgccaacgagauggggcugaucgagaagaccaagaccgacuucggcuucuaccaggucaagacggagaccaccauccucgacguggaccugcggcccgccuccgcguggacccuguacgccguggccacgaccauccucaccccgaugcugcgccacaccaucgagaacacgagcgccaaccugucccucgccgcgaucgccaaccaggccgccguccugauggggcugggcaagggcuggccccuccaccggauggaccugggggugccccugcucgccaugggcugcuacagccaggugaaccccaccacccugaccgcgucccuggucaugcuccuggugcacuacgccaucaucgggccgggccugcaggccaaggccacgcgcgaggcgcagaagcggaccgccgccggcaucaugaagaaccccaccguggacgggaucaccgucaucgaccucgagcccaucagcuacgaccccaaguucgagaagcagcugggccaggugaugcugcucgugcugugcgccgggcagcugcuccugaugcgcacgaccugggccuucugcgagguccugacccucgcgaccggcccgauccugacgcugugggaggggaaccccggccgguucuggaacaccaccaucgccguguccaccgccaacaucuuccgcggcagcuaccucgccggggccggccuggcguucucccugaucaagaacgcccagacgccccggcgcgggaccggcaccgccggggagacccucggcgagaaguggaagcggcagcugaacagccuggaccgcaaggaguucgaggaguacaagcgguccggcauccucgagguggaccgcaccgaggccaagagcgcccugaaggacggguccaagaucaagcacgcggucagccggggcuccagcaagauccgcuggaucguggagcgcgggauggugaagcccaagggcaaggucguggaccuggggugcggccggggcgggugguccuacuacauggccacgcucaagaacgugaccgaggucaagggcuacaccaaggggggcccggggcacgaggagcccauccccauggccaccuacggcuggaaccuggugaagcugcacagcggcguggacgucuucuacaagcccacggagcagguggacacccuccugugcgacaucggggagagcuccagcaacccgaccaucgaggagggccgcacccugcgggugcucaagauggucgagcccuggcuguccagcaagcccgaguucugcaucaaggugcugaaccccuacaugccgacggugaucgaggagcuggagaagcuccagcgcaagcacgggggcaaccugguccggugcccccugucccgcaacagcacccacgagauguacuggguguccggcgccagcgggaacaucgucuccagcgugaacaccaccuccaagaugcuccugaaccgguucacgacccgccaccggaagcccaccuacgagaaggacguggaccugggcgcggggacccgcagcgucuccacggagaucgagaagcccgacaugaccaucaucggccggcgccuccagcggcugcaggaggagcacaaggagaccuggcacuacgaccaggagaacccguaccgcaccugggccuaccacgggagcuacgaggcccccuccacgggcagcgccuccagcauggugaacggcguggucaagcugcucaccaagcccugggacgugaucccgauggugacccagcuggccaugaccgacacgacccccuucgggcagcagcgggucuucaaggagaagguggacacccgcaccccccagcccaagccgggcacgcggauggugaugaccaccaccgcgaacuggcugugggcccuccuggggaagaagaagaacccccgccugugcacgcgggaggaguucaucuccaagguccgcagcaacgccgccaucggcgccguguuccaggaggagcagggguggaccagcgcguccgaggccgugaacgacagccgguucugggagcucgucgacaaggagcgcgcccugcaccaggagggcaagugcgaguccugcguguacaacaugaugggcaagcgcgagaagaagcugggggaguucggccgggccaaggggagccgcgccaucugguacauguggcucggcgcgcgguuccuggaguucgaggcccugggguuccucaacgaggaccacugguucggccgcgagaacuccuggagcggcguggagggggagggccugcaccggcugggguacauccucgaggagaucgacaagaaggacggcgaccugauguacgccgacgacaccgccggcugggacacccgcaucacggaggacgaccugcagaacgaggagcucaucaccgagcagauggcgccccaccacaagauccuggccaaggccaucuucaagcugaccuaccagaacaaggucgugaaggugcuccggcccaccccgcgcggggccgucauggacaucaucucccggaaggaccagcgcggcagcgggcaggugggcaccuacgggcugaacacguucaccaacauggaggugcagcugauccggcagauggaggccgagggcgucaucacccaggacgacaugcagaaccccaagggccucaaggagcgcguggagaaguggcugcgggagugcgggguggaccgccugaagcggauggcgaucuccggcgacgacugcgucgugaagccccucgacgagcgcuucgggaccagccugcuguuccucaacgacaugggcaaggugcggaaggacaucccccagugggagccguccaagggguggaagaacuggcaggagguccccuucugcagccaccacuuccacaagaucuucaugaaggacggccgcucccugguggugcccugccggaaccaggacgagcugaucggccgcgcccgcaucagccagggggccggcuggucccuccgggagacggccugccuggggaaggccuacgcgcagauguggagccugauguacuuccaccgccgggaccuccgccuggccuccauggccaucugcagcgccguccccaccgagugguucccgaccagccggaccacgugguccauccacgcccaccaccaguggaugaccaccgaggacaugcugaagguguggaaccgcguguggaucgaggacaaccccaacaugaucgacaagacccccguccacagcugggaggacauccccuaccucggcaagcgggaggaccuguggugcgggucccugaucggccucagcucccgcgcgacgugggccaagaacauccacaccgccaucacccaggugcggaaccugaucggcaaggaggaguacguggacuacaugagcgucaugaagcgcuacuccgccccgagcgaguccgagggggugcuguga

SEQ ID NO: 10487 - RNA, 9867 nt, Artificial Sequence
  derived and/or modified CDS sequence (opt1) from DENV-4__KC762694__SS-prME
agcaccaugacccugcucugccugauccccaccgugauggccuuccaccuguccacccgggacggcgagccgcucaugaucguggccaagcacgagcgggggcgcccccugcuguucaagaccaccgagggcaucaacaagugcacgcucaucgccauggaccugggggagaugugcgaggacaccgugaccuacaagugcccccugcucgugaacaccgagcccgaggacaucgacugcuggugcaaccugacgagcaccugggugauguacgggaccugcacccaguccggggagcggcgccgggagaagcgcagcguggcccugacgccgcacuccggcaugggccucgagacccgggccgagaccuggaugagcuccgagggggccuggaagcacgcccagcgcguggagagcuggauccugcggaaccccggcuucgcgcugcucgccggguucauggccuacaugaucggccagaccgggauccagcgcacggucuucuucgugcugaugaugcugguggcccccuccuacggcaugcggugcgucggcguggggaaccgcgacuucguggagggcgucagcgggggcgcguggguggaccucgugcuggagcacggcgggugcgucaccaccauggcccagggcaagcccacccuggacuucgagcucacgaagaccaccgccaaggagguggcccugcugcggaccuacugcaucgaggccuccaucagcaacaucacgaccgcgacccgcugcccgacccagggggagcccuaccucaaggaggagcaggaccagcaguacaucugccggcgcgacguggucgaccggggcugggggaacggcugcggccuguucgggaagggcgggguggugacgugcgccaaguuccugugcuccggcaagaucaccgggaaccucguccagaucgagaaccuggaguacaccgugguggucaccgugcacaacggcgacacgcacgccgucggcaacgacaccagcaaccacggggugaccgccaccaucacgccccgcucccccagcguggaggucaagcugccggacuacggcgagcucacccuggacugcgagccccgguccgggaucgacuucaacgagaugauccugaugaagaugaagaagaagaccuggcucgugcacaagcagugguuccuggaccugccccuccccuggaccgccggcgcggacaccagcgaggugcacuggaacuacaaggagcgcauggucacguucaaggugccgcacgccaagcggcaggacgugaccguccuggggucccaggagggcgccaugcacagcgcccuggccggcgcgaccgagguggacagcggggacggcaaccacauguucgccgggcaccucaagugcaaggugcgcauggagaagcugcgcaucaagggcauguccuacaccaugugcagcggcaaguucuccaucgacaaggagauggccgagacgcagcacgggaccaccgucgugaaggugaaguacgagggcgccggggcccccugcaagguccccaucgagauccgggacgugaacaaggagaagguggucggccgcaucaucagcuccacccccuucgcggagaacacgaacagcgugaccaacaucgagcuggagccgcccuucggggacuccuacaucgugaucggcgucggcgacagcgcccucacccugcacugguuccggaagggguccagcaucggcaagauguucgaguccaccuaccgcggggccaagcggauggccauccugggcgagacggcgugggacuucgggagcgugggcggccucuucaccucccuggggaaggccgugcaccaggucuucggcagcguguacaccaccauguucgggggcguguccuggaugauccgcauccugaucggguuccucguccuguggaucggcacgaacagccggaacaccuccauggccaugaccugcaucgccgugggcgggaucacccuguuccugggcuucacggugcaggccgacauggggugcgucgugagcuggaacggcaaggagcucaagugcggguccggcaucuucguggucgacaacgugcacaccuggaccgagcaguacaaguuccagcccgagagccccgcgcgccuggccagcgccauccugaacgcccacaaggacggcgugugcgggauccgguccaccagccgccucgagaacgucauguggaagcagaucacgaacgagcugaacuacgugcugugggagggcgggcacgaccucaccguggucgccggcgacgugaagggcgugcugaccaaggggaagcgggcgcugaccccgcccgucaacgaccucaaguacuccuggaagacguggggcaaggccaagaucuucacccccgaggcccgcaacagcaccuuccugaucgacgggcccgacaccuccgagugcccgaacgagcggcgcgccuggaacuucuucgagguggaggacuacggcuucgggauguucacgaccaacaucuggaugaaguuccgggagggcagcuccgaggugugcgaccaccgccugaugagcgccgcgaucaaggaccagaaggccguccacgccgacaugggcuacuggaucgaguccagcaagaaccagaccuggcagaucgagaaggccucccucaucgaggugaagaccugccuguggcccaagacgcacacccuguggagcaacggggugcucgagucccagaugcugaucccccggagcuacgcgggcccguucucccagcacaacuaccgccagggguacgccacccagaccgccggccccuggcaccuggggaagcucgagaucgacuucggcgagugccccggcaccacggucaccauccaggaggacugcgaccaccgggggcccagccugcgcaccaccacggccuccggcaagcuggugacccaguggugcugccgcagcugcaccaugccgccccuccgguuccugggggaggacggcugcugguacgggauggagauccgcccccugagcgagaaggaggagaacauggugaagucccaggucaccgccggccagggcacgagcgagaccuucuccauggggcuccugugccugacccucuucguggaggagugccugcggcgccgggucacccgcaagcacaugauccuggugguggucaucacguucugcgcgaucauccucggcgggcugaccuggauggaccugcuccgggcccugaucaugcugggcgacaccaugagcggccgcaucgggggccagauccaccucgccaucauggccguguucaagaugucccccggguacgugcugggcgucuuccugcggaagcucaccagccgcgagacggcccugauggugaucgggauggcgaugaccaccguguucuccaucccgcacgaccugauggagcucaucgacggcaucagccugggccugauccuccugaagaucgucacccacuucgacaacacccagguggggacccuggcccucucccugaccuucauccggagcaccacgccccuggugauggccuggcgcaccaucauggccgucuucuucguggugacccucaucccccugugccggaccuccugccugcagaagcagagccacugggucgagaucacggcccucauccugggcgcgcaggcccugcccguguaccucaugacccugaugaagggggccucccgccggagcuggccgcugaacgagggcaucauggccguggggcucgucucccugcugggcagcgcgcuccugaagaacgacgugccccuggccggccccaugguggccgggggccuccugcuggccgccuacgucauguccgggagcuccgcggaccucagccuggagaaggccgccaacgugcagugggacgagauggccgacaucaccggcagcucccccaucaucgaggugaagcaggacgaggacgggagcuucuccauccgcgacgucgaggagaccaacaugaucacgcugcucgugaagcuggcccugaucaccgugagcggccucuacccgcuggcgauccccgucaccauggcccugugguacguguggcaggucaagacccagcgguccggcgcccucugggacguccccagccccgccgccacgcagaaggcgacccuguccgaggggguguaccgcaucaugcagcggggccuguucgggaagacccaggugggcgucgggauccacauggagggcguguuccacaccauguggcacgugacccgcggcagcgucaucugccacgagacggggcggcucgagccguccugggccgacgugcgcaacgacaugaucagcuacggcgggggcuggcgccugggcgacaagugggacaaggaggaggacgugcagguccuggccaucgagcccgggaagaaccccaagcacgugcagaccaagcccggccucuucaagacccugaccggggagaucggcgccgugacgcuggacuucaagccggggaccuccggcagccccaucaucaacaagaagggcaaggucaucgggcucuacggcaacgggguggugaccaaguccggcgacuacgucagcgccaucacccaggcggagcggaucggggagcccgacuacgagguggacgaggacaucuuccgcaagaagcggcugacgaucauggaccugcacccgggcgccggcaagaccaagcgcauccuccccuccaucgugcgggaggcccugaagcgccggcugcgcacccucauccuggcccccacccgggucguggcggccgagauggaggaggcccugcgcgggcugcccauccgguaccagacgccggccgugaaguccgagcacaccggccgcgagaucgucgaccucaugugccacgccaccuucaccacgcggcugcuguccagcacccgcgugcccaacuacaaccucaucgucauggacgaggcgcacuucaccgaccccugcuccguggccgcccggggguacaucagcacccgcguggagaugggcgaggccgccgcgaucuucaugacggccacgcccccggggagcaucgaccccuucccccaguccaacagccccaucgaggacaucgagcgggagaucccggagcgcuccuggaacaccggcuucgacuggaucaccgacuaccagggcaagacggucugguucgugcccagcaucaaggccgggaacgacaucgccaacugccugcggaaguccggcaagcgcgugauccagcugagccgcaagaccuucgacaccgaguaccccaagaccaagcucacggacugggacuucgucgugaccaccgacaucuccgagaugggggccaacuuccgggcgggccgcgugaucgacccccggcgcugccugaagccggucauccugaccgacgggcccgagcgggugauccucgccggccccauccccgugacgccggccagcgccgcgcagcgccggggccgcaucgggcggaaccccgcccaggaggacgaccaguacgucuucuccggcgacccccugaagaacgacgaggaccacgcccacuggaccgaggccaagaugcugcucgacaacaucuacacccccgaggggaucaucccgacccuguucggccccgagcgcgagaagacgcaggccaucgacggcgaguuccggcugcgcggggagcagcggaagaccuucguggagcucaugcgccggggcgaccugcccguguggcugagcuacaaggucgcguccgccgggaucagcuacaaggaccgcgaguggugcuucaccggcgagcggaacaaccagauccucgaggagaacauggagguggagaucuggacccgcgagggggagaagaagaagcugcggcccaaguggcuggacgcccgcguguacgccgacccgauggcccucaaggacuucaaggaguucgcguccggccgcaagagcaucacgcuggacauccugaccgagaucgccacccuccccaccuaccuguccagcaaggccaagcuggcccucgacaacaucgucaugcugcacaccacggagaagggcgggcgcgccuaccagcacgcgcugaacgagcuccccgagucccuggagacccugaugcucguggcccugcugggcgccaugaccgccgggaucuuccucuucuucaugcagggcaaggggaucggcaagcugagcaugggccugaucgcgaucgccguggccuccgggcuccugugggucgccgagauccagccgcaguggaucgccgcgagcaucauccuggaguucuuccucauggugcugcugauccccgagcccgagaagcagcgcacgccccaggacaaccagcucaucuacgugauccugacgauccugaccaucaucggccucaucgccgccaacgagauggggcugaucgagaagaccaagaccgacuucggcuucuaccaggucaagacggagaccaccauccuggacguggaccuccggccggccagcgccuggacccuguacgcgguggccacgaccauccugacccccaugcuccgccacaccaucgagaacacguccgccaaccugagccuggccgccaucgcgaaccaggccgccguccucauggggcugggcaagggcuggccccugcaccggauggaccucggggugccccugcuggccaugggcugcuacucccaggugaacccgaccacccucaccgccagccuggucaugcugcucgugcacuacgcgaucaucgggcccggccugcaggccaaggccacgcgcgaggcccagaagcggaccgcggccggcaucaugaagaaccccaccguggacgggaucaccgucaucgaccuggagcccaucuccuacgacccgaaguucgagaagcagcucggccaggugaugcugcuggugcucugcgucgggcagcugcugcucaugcgcacgaccugggcccugugcgaggugcugacccucgccaccggccccgugaugacgcugugggaggggaaccccggccgguucuggaacaccaccaucgccgucagcaccgcgaacaucuuccgcggcuccuaccuggccggggccggccucgccuucagccugaucaagaacgcccagacgccccggcgcgggaccggcaccaccggggagacgcugggcgagaaguggaagcggcagcucaacucccuggaccgcaaggaguucgaggaguacaagcggagcggcauccuggagguggaccgcaccgaggcgaaguccgcccuccgggacgggagcaagaucaaguacgccgugucccgcggcagcuccaagauccgguggaucgucgagcgcgggaugaucaagccgaagggcaaggugguggaccuggggugcggccggggcggguggagcuacuacauggccacccugaagaacgucaccgaggugaagggcuacaccaagggcggccccgggcacgaggagcccauccccauggccacguacggcuggaaccucgugaagcugcacuccggcgucgacguguucuacaagccgaccgagcaggucgacacccugcucugcgacaucggggagagcuccagcaaccccaccaucgaggagggccgcacgcugcgcguccugaagaugguggagcccuggcucagcuccaagcccgaguucugcaucaagguccugaacccguacaugcccaccgugaucgaggagcuggagaagcuccagcggcgccacgggggcagccuggugcggugcccccugucccgcaacagcacccacgagauguacugggucuccggcgcgagcgggaacaucguguccagcgugaacaccaucuccaagaugcugcucaaccgguucacgacccgccaccggaagcccaccuacgagaaggacgucgaccugggcgccgggacccgcagcguguccacggagaccgagaagccggacaugaccaucaucggccggcgccugcagcggcuccgcgaggagcacaaggagaccuggcacuacgaccaggagaaccccuaccggacgugggccuaccacgggagcuacgaggcccccuccaccggcagcgcguccagcauggugaacggcgucgugaagcugcugaccaagccgugggacgugauccccauggucacccagcucgccaugacggacaccacccccuucgggcagcagcgcguguucaaggagaagguggacacccggacgccccagccgaagcccggcacccgcaugaucaugaccaccacggccaacuggcugugggcccugcucgggaagaagaaguccccgcggcugugcacccgcgaggaguucaucagcaagguccggagcaacgccgcgaucggcgccguguuccaggaggagcagggguggaccagcgccagcgaggccgugaacgacucccgcuucugggagcuggucgacaaggagcgggcccuccaccaggagggcaagugcgagagcugcguguacaacaugaugggcaagcgcgagaagaagcugggggaguucggccgcgcgaaggggucccgggccaucugguacauguggcugggcgcccgcuuccucgaguucgaggcccugggguuccugaacgaggaccacugguucagccgggagaacuccuggagcggcguggagggcgaggggcuccaccgccugggcuacauccuggaggacaucgacaagaaggacggggaccucaucuacgccgacgacaccgcgggcugggacacgcggaucaccgaggacgaccugcugaacgaggagcucaucaccgagcagauggcgccccaccacaagacccuggccaaggccaucuucaagcugacguaccagaacaaggucgugaaggugcuccgccccacccccaagggcgcggucauggacaucaucucccggaaggaccagcgcgggagcggccagguggggaccuacggccugaacaccuucaccaacauggaggugcagcugauccggcagauggaggccgagggggucaucacgcaggacgacaugcagaaccccaagggccucaaggagcgcguggagaaguggcugaaggagugcggcguggaccggcugaagcgcauggccaucuccggggacgacugcgucgugaagccccucgacgagcgguucagcaccucccugcuguuccucaacgacaugggcaaggugcgcaaggacaucccgcagugggagcccagcaagggguggaagaacuggcaggagguccccuucugcucccaccacuuccacaagaucuucaugaaggacggccggagccugguggugcccugccgcaaccaggacgagcugaucgggcgggcccgcaucucccagggcgccggcuggagccuccgggagaccgcgugccuggggaaggccuacgcccagauguggucccugauguacuuccaccgccgcgaccuccggcuggccagcauggccaucugcagcgcggucccgaccgagugguuccccacgucccgcaccaccuggagcauccacgcccaccaccaguggaugaccacggaggacaugcugaagguguggaaccggguguggaucgaggacaaccccaacaugaccgacaagacccccguccacuccugggaggacaucccguaccucggcaagcgcgaggaccuguggugcgggagccugaucggccucuccagccgggccaccugggccaagaacauccacacggccaucacccaggugcgcaaccugaucgggaaggaggaguacguggacuacaugcccgcgaugaagcgguacuccgcccccuucgagagcgagggcguccuguga

SEQ ID NO: 10488 - RNA, 9867 nt, Artificial Sequence
  derived and/or modified CDS sequence (opt1) from DENV-4__KC762695__SS-prME
agcaccaugacccugcucugccugauccccaccgccauggccuuccaccugagcacccgggacggcgagccgcucaugaucguggcgaagcacgagcgggggcgcccccugcuguucaagaccaccgagggcaucaacaagugcacgcucaucgccauggaccugggggagaugugcgaggacaccgugaccuacaagugcccccugcucgugaacaccgagcccgaggacaucgacagcuggugcaaccugacguccaccugggugauguacgggaccugcacccagagcggggagcggcgccgggagaagcgcuccguggcccugacgccgcacagcggcaugggccucgagacccgggccgagaccuggauguccagcgagggggccuggaagcacgcgcagcgcguggaguccuggauccugcggaaccccggcuucgcccugcucgccggguucauggccuacaugaucggccagaccgggauccagcgcacgguguucuucguccugaugaugcugguggcgcccagcuacggcaugcggugcgugggcgucgggaaccgcgacuucguggagggcguguccgggggcgccugggucgaccucgugcuggagcacggcgggugcgugaccaccauggcccagggcaagcccacccuggacuucgagcucacgaagaccaccgccaaggaggucgcccugcugcggaccuacugcaucgaggcgagcaucuccaacaucacgaccgccacccgcugcccgacccagggggagcccuaccucaaggaggagcaggaccagcaguacaucugccggcgcgacgugguggaccggggcugggggaacggcugcggccuguucgggaagggcggggucgugacgugcgccaaguuccugugcagcggcaagaucaccgggaaccucgugcagaucgagaaccuggaguacaccgucguggugaccguccacaacggcgacacgcacgccgugggcaacgacaccuccaaccacggggucaccgccaccaucacgccccgcagccccuccguggaggugaagcugccggacuacggcgagcucacccuggacugcgagccccggagcgggaucgacuucaacgagaugauccugaugaagaugaagaagaagaccuggcucguccacaagcagugguuccuggaccugccccuccccuggaccgcgggcgccgacaccuccgaggugcacuggaacuacaaggagcgcauggugacguucaaggucccgcacgccaagcggcaggacgugaccgugcuggggagccaggagggcgccaugcacagcgcccuggcgggcgccaccgaggucgacuccgggaacggcaaccacauguucgccgggcaccucaagugcaaggugcgcauggagaagcugcgcaucaagggcaugagcuacaccaugugcuccggcaaguucagcaucgacaaggagauggccgagacgcagcacgggaccaccguggucaaggugaaguacgagggcgccggggcgcccugcaaggugcccaucgagauccgggacgucaacaaggagaagguggugggccgcaucaucuccagcacccccuucgccgagaacacgaacuccgucaccaacaucgagcuggagccgcccuucggggacagcuacaucgugaucggcgugggcgacuccgcccucacccugcacugguuccggaaggggagcuccaucggcaagauguucgagagcaccuaccgcggggccaagcggauggcgauccugggcgagacggccugggacuucggguccgucggcggccucuucaccagccuggggaaggccauccaccagguguucggcuccguguacaccaccauguucgggggcgucagcuggaugauccgcauccugaucgggcuccuggugcuguggaucggcacgaacucccggaacaccagcauggccaugaccugcaucgccgugggcgggaucacccuguuccucggcuucacgguccaggcggacauggggugcgugguguccuggaacggcaaggagcugaagugcgggagcggcaucuucgucguggacaacgugcacaccuggaccgagcaguacaaguuccagcccgagagccccgcccgccuggccuccgccauccucaacgcccacaaggacggcgucugcgggauccggagcaccacgcgccuggagaacgugauguggaagcagaucaccaacgagcugaacuacgugcucugggagggcgggcacgaccugaccgucguggcgggcgacgugaagggcguccugaccaaggggaagcgggcccucacgccgcccgugaacgaccugaaguacuccuggaagaccuggggcaaggccaagaucuucacccccgaggcccgcaacagcaccuuccugaucgacgggcccgacacguccgagugcccgaacgagcggcgcgccuggaacuuccucgagguggaggacuacggcuucgggauguucagcaccaacaucuggaugaaguuccgggagggcuccagcgaggucugcgaccaccgccugauguccgcggccaucaaggaccagaaggccgugcacgccgacaugggcuacuggaucgagagcuccaagaaccagaccuggcagaucgagaaggcgagccugaucgaggugaagaccugccucuggcccaagacgcacacccugugguccaacgggguccuggagagccagaugcucaucccccgguccuacgccggcccguucagccagcacaacuaccgccagggguacgccacccagaucgccggccccuggcaccuggggaagcuggagaucgacuucggcgagugccccggcaccaccgugacgauccaggaggacugcgaccaccgggggcccucccuccgcaccaccaccgccagcggcaagcuggugacgcaguggugcugccgcagcugcaccaugccgccccugcgguuccucggggaggacggcugcugguacgggauggagauccgcccccuguccgagaaggaggagaacauggucaagagccaggugaccgcgggccagggcaccuccgagacguucagcauggggcugcucugccugacccuguucguggaggagugccuccggcgccgggucacccgcaagcacaugauccugguggucaccaucacguucugcgccaucauccugggcgggcucaccuggauggaccugcugcgggcccucaucaugcugggcgacaccauguccggccgcaucgggggccagauccaccuggccaucauggccguguucaagaugagccccggguacgugcucggcgucuuccugcggaagcugaccucccgcgagacggcgcucauggugaucgggauggccaugaccaccguguucagcaucccgcacgaccugauggagcugaucgacggcaucucccucggccugauccugcucaagaucgucacccacuucgacgacacccagguggggacccuggcccugagccucaccuucauccgguccaccacgccccuggugauggccuggcgcaccaucauggccgucuucuucguggugacccugaucccccucugccggaccagcugccugcagaagcagucccacugggucgagaucacggcgcugauccucggcgcccaggcccugcccguguaccugaugacccucaugaagggggccagccgccgguccuggccgcugaacgagggcaucauggcgguggggcuggucagccuccugggcuccgcccugcucaagaacgacgugccccuggccggccccaugguggccgggggccugcuccuggccgcguacgucaugagcggguccagcgccgaccugagccucgagaaggccgccaacgugcagugggacgagauggccgacaucaccggcuccagccccaucaucgaggugaagcaggacgaggacggguccuucagcauccgcgacgucgaggagaccaacaugaucacgcugcuggugaagcucgcgcugaucaccguguccggccuguacccgcucgccauccccgucaccauggcccugugguacaucuggcaggucaagacccagcggagcggcgcccugugggacgugcccucccccgucgccacgcagaaggcgacccucagcgaggggguguaccgcaucaugcagcggggccuguucgggaagacccaggugggcgucgggauccacauggagggcguguuccacaccauguggcacgugacccgcggcuccgucaucugccacgagacggggcggcuggagccgagcugggccgacgugcgcaacgacaugaucuccuacggcgggggcuggcgccucggcgacaagugggacaaggaggaggacgugcagguccuggccaucgagcccgggaagaaccccaagcacgugcagaccaagcccggccuguucaagacccucaccggggagaucggcgccgugacgcuggacuucaagccggggaccagcggcucccccaucaucaacaagaagggcaaggucaucgggcuguacggcaacgggguggugaccaagagcggcgacuacgucuccgccaucacccaggcggagcggaucggggagcccgacuacgagguggacgaggacaucuuccgcaagaagcggcucacgaucauggaccugcacccgggcgccggcaagaccaagcgcauccugcccagcaucgugcgggaggcccucaagcgccggcugcgcacccugauccuggcccccacccgggucguggcggccgagauggaggaggcccuccgcgggcugcccauccgguaccagacgccggccgugaaguccgagcacaccggccgcgagaucgucgaccugaugugccacgccaccuucaccacgcggcuccugagcuccacccgcgugcccaacuacaaccugaucgugauggacgaggcgcacuucaccgaccccugcagcgucgccgcccggggguacaucagcacccgcguggagaugggcgaggccgccgcgaucuucaugacggccacgcccccgggguccaccgaccccuucccccagagcaacucccccaucgaggacaucgagcgggagaucccggagcgcagcuggaacaccggcuucgacuggaucacggacuaccagggcaagaccgucugguucgugcccuccaucaaggccgggaacgacaucgccaacugccuccgcaagagcggcaagcgcgugauccagcugucccgcaagaccuucgacaccgaguaccccaagacgaagcugaccgacugggacuucgucgugaccaccgacaucagcgagaugggggccaacuuccgggcgggccgcgugaucgacccccggcgcugccucaagccggucauccugacggacgggcccgagcgggugauccuggccggccccauccccgugaccccggccuccgccgcgcagcgccggggccgcaucgggcggaaccccgcccaggaggacgaccaguacgucuucagcggcgacccccucaagaacgacgaggaccacgcccacuggaccgaggccaagaugcugcuggacaacaucuacacccccgaggggaucaucccgacccucuucggccccgagcgcgagaagacccaggccaucgacggcgaguuccggcugcgcggggagcagcggaagaccuucguggagcugaugcgccggggcgaccuccccguguggcuguccuacaaggucgcgagcgccgggaucuccuacaaggaccgcgaguggugcuucaccggcgagcggaacaaccagauccuggaggagaacauggagguggagaucuggacgcgcgagggggagaagaagaagcuccggcccaaguggcuggacgcccgcguguacgccgacccgauggcccugaaggacuucaaggaguucgcgagcggccggaaguccaucacccucgacauccugaccgagaucgccacccugcccaccuaccucagcuccaaggccaagcuggcccuggacaacaucgucaugcuccacacgaccgagaagggcgggcgcgccuaccagcacgcgcugaacgagcugcccgagagccucgagacccugaugcugguggcccuccugggcgccaugaccgccgggaucuuccuguucuucaugcagggcaaggggaucggcaagcucuccaucggccugaucgcgaucgccguggccagcgggcugcucugggucgccgagauccagccgcaguggaucgccgcgagcaucauccuggaguucuuccugauggugcuccugauccccgagcccgagaagcagcgcacgccccaggacaaccagcugaucuacgugauccucaccauccugaccaucaucggccugaucgccgccaacgagauggggcucaucgagaagaccaagacggacuucggcuucuaccaggucaagaccgagaccaccauccuggacguggaccugcggccggccuccgccuggacgcucuacgcgguggccaccaccauccugacccccaugcugcgccacacgaucgagaacaccagcgccaaccucucccuggccgccaucgcgaaccaggccgccguccugauggggcucggcaagggcuggccccugcaccggauggaccugggggugccccuccuggccaugggcugcuacagccaggugaacccgaccacccugacggccucccucgucaugcugcuggugcacuacgcgaucaucgggcccggccuccaggccaaggccacccgcgaggcccagaagcggaccgcggccggcaucaugaagaaccccaccguggacgggaucacggucaucgaccuggagcccaucagcuacgacccgaaguucgagaagcagcugggccaggugaugcuccuggugcugugcgucgggcagcuccugcugaugcgcaccaccugggcccucugcgaggugcugacccuggccacgggccccaucaugacccucugggaggggaaccccggccgguucuggaacaccaccaucgccguguccacggcgaacaucuuccgcggcagcuaccuggccggggccggccuggccuucucccucaucaagaacgcccagacgccccggcgcgggaccggcaccacgggggagacccugggcgagaaguggaagcggcagcugaacagccucgaccgcaaggaguucgaggaguacaagcgguccggcauccuggaggucgaccgcaccgaggccaagagcgcccugcgggacggguccaagaucaagcacgccgugagccgcggcuccagcaagauccgguggaucguggagcgcgggaugaucaagccgaagggcaaggucguggaccucgggugcggccggggcgggugguccuacuacauggccacccugaagaacgugaccgaggucaagggcuacacgaagggcggccccgggcacgaggagcccauccccauggccaccuacggcuggaaccuggugaagcuccacagcggcguggacgucuucuacaagccgaccgagcaggucgacacccugcugugcgacaucggggaguccagcagcaaccccacgaucgaggagggccgcacccuccgcgugcugaagauggucgagcccuggcuguccagcaagcccgaguucugcaucaaggugcucaacccguacaugcccaccgugaucgaggagcuggagaagcugcagcggcgccacgggggcucccugguccggugcccccucagccgcaacuccacccacgagauguacugggugagcggcgcguccgggaacaucgucagcuccgugaacacgaucagcaagaugcugcugaaccgguucaccacccgccaccggaagcccaccuacgagaaggacguggaccucggcgccgggacgcgcuccgucagcaccgagaccgagaagccggacaugaccaucaucggccggcgccugcagcggcugcgcgaggagcacaaggagacguggcacuacgaccaggagaaccccuaccggaccugggccuaccacggguccuacgaggcccccagcaccggcuccgcgagcuccauggugaacggcguggucaagcuccugaccaagccgugggacgugauccccauggugacgcagcuggccaugaccgacaccacccccuucgggcagcagcgcgucuucaaggagaagguggacacgcggacgccccagccgaagcccggcacccgcaugaucaugaccacgaccgccaacuggcucugggcccugcuggggaagaagaaguccccgcggcucugcacccgcgaggaguucaucuccaaggugcggagcaacgccgcgaucggcgccgucuuccaggaggagcagggguggaccagcgccuccgaggccgugaacgacagccgcuucugggagcugguggacaaggagcgggcccugcaccaggagggcaagugcgaguccugcgucuacaacaugaugggcaagcgcgagaagaagcucggggaguucggccgcgcgaaggggagccgggccaucugguacauguggcugggcgcccgcuuccuggaguucgaggcccucggguuccugaacgaggaccacugguucucccgggagaacagcugguccggcguggagggcgaggggcugcaccgccucggcuacauccuggaggacaucgacaagaaggacggggaccugaucuacgccgacgacacggcgggcugggacacccggaucaccgaggacgaccuccugaacgaggagcugaucaccgagcagauggcgccccaccacaagacgcucgccaaggccaucuucaagcugaccuaccagaacaagguggucaaggugcugcgccccacccccaagggcgcggugauggacaucaucagccggaaggaccagcgcggguccggccaggucgggaccuacggccucaacaccuucacgaacauggaggugcagcugauccggcagauggaggccgagggggugaucacccaggacgacaugcagaaccccaagggccuggaggagcgcgucgagaaguggcucaaggagugcggcguggaccggcugaagcgcauggccaucagcggggacgacugcguggucaagccccuggacgagcgguucuccaccagccuccuguuccugaacgacaugggcaaggugcgcaaggacaucccgcagugggagcccuccaagggguggaagaacuggcaggaggugcccuucugcagccaccacuuccacaagaucuucaugaaggacggccggucccucgucgugcccugccgcaaccaggacgagcugaucgggcgggcccgcaucagccagggcgccggcuggucccugcgggagaccgcgugccucgggaaggccuacgcccagauguggagccugauguacuuccaccgccgcgaccugcggcucgccagcauggccaucugcuccgcggugccgacggagugguuccccaucagccgcaccaccugguccauccacgcccaccaccaguggaugaccacggaggacaugcugaaggucuggaaccggguguggaucgaggacaaccccaacaugaccgacaagacccccauccacagcugggaggacaucccguaccugggcaagcgcgaggaccucuggugcgggucccugaucggccugagcucccgggccaccugggccaagaacauccacacggccaucagccaggugcgcaaccucaucgggaaggaggaguacgucgacuacaugcccgugaugaagcgguacuccgcgcccagcgaguccgagggcgugcuguga

SEQ ID NO: 10489 - RNA, 9867 nt, Artificial Sequence
  derived and/or modified CDS sequence (opt1) from DENV-4__KC762696__SS-prME
agcaccaugacccugcucugccugauccccaccgugauggccuuccaccugagcacccgggacggcgagccgcucaugaucguggccaagcacgagcgggggcgcccccugcuguucaagaccaccgagggcaucaacaagugcacccucaucgcgauggaccugggggagaugugcgaggacaccgugaccuacaagugcccccugcucgugaacaccgagcccgaggacaucgacugcuggugcaaccugaccagcaccugggugauguacgggaccugcacccaguccggggagcggcgccgggagaagcgcagcguggcccugacgccgcacuccggcaugggccucgagacccgggccgagaccuggaugagcuccgagggggccuggaagcacgcccagcgcguggagagcuggauccugcggaaccccggcuucgcgcugcucgccggguucauggccuacaugaucggccagaccgggauccagcgcacgguguucuucgugcugaugaugcugguggcccccuccuacggcaugcggugcgucggcguggggaaccgcgacuucguggagggcgucagcgggggcgcguggguggaccucgugcuggagcacggcgggugcgucaccaccauggcccagggcaagcccacccuggacuucgagcucacgaagaccaccgccaaggagguggcccugcugcggaccuacugcaucgaggccuccaucagcaacaucacgaccgcgacccgcugcccgacccagggggagcccuaccucaaggaggagcaggaccagcaguacaucugccggcgcgacguggucgaccggggcugggggaacggcugcggccuguucgggaagggcgggguggugacgugcgccaaguuccugugcuccggcaagaucaccgggaaccucguccagaucgagaaccuggaguacaccgugguggucaccgugcacaacggcgacacgcacgccgucggcaacgacaccagcaaccacggggugaccgccaccaucacgccccgcucccccagcguggaggucaagcugccggacuacggcgagcucacccuggacugcgagccccgguccgggaucgacuucaacgagaugauccugaugaagaugaagaagaagaccuggcucgugcacaagcagugguuccuggaccugccccuccccuggaccgccggcgcggacaccagcgaggugcacuggaacuacaaggagcgcauggucacguucaaggugccgcacgccaagcggcaggacgugaccguccuggggucccaggagggcgccaugcacagcgcccuggccggcgcgaccgagguggacagcggggacggcaaccacauguucgccgggcaccucaagugcaaggugcgcauggagaagcugcgcaucaagggcauguccuacaccaugugcagcggcaaguucuccaucgacaaggagauggccgagacgcagcacgggaccaccgucgugaaggugaaguacgagggcgccggggcccccugcaagguccccaucgagauccgggacgugaacaaggagaagguggucggccgcaucaucagcuccacccccuucgcggagaacacgaacagcgugaccaacaucgagcuggagccgcccuucggggacuccuacaucgugaucggcgucggcgacagcgcccucacccugcacugguuccggaagggguccagcaucggcaagauguucgaguccaccuaccgcggggccaagcggauggccauccugggcgagacggcgugggacuucgggagcgugggcggccucuucaccucccuggggaaggccgugcaccaggucuucggcagcguguacaccaccauguucgggggcguguccuggaugauccgcauccugaucggguuccucguccuguggaucggcacgaacagccggaacaccuccauggccaugaccugcaucgccgugggcgggaucacccuguuccugggcuucacggugcaggccgacauggggugcgucgugagcuggaacggcaaggagcucaagugcggguccggcaucuucguggucgacaacgugcacaccuggaccgagcaguacaaguuccagcccgagagccccgcgcgccuggccagcgccauccugaacgcccacaaggacggcgugugcgggauccgguccaccacgcgccucgagaacgucauguggaagcagaucaccaacgagcugaacuacgugcugugggagggcgggcacgaccucaccguggucgccggcgacgugaagggcgugcugaccaaggggaagcgggcgcugacgccgcccgucaacgaccucaaguacagcuggaagaccuggggcaaggccaagaucuucacccccgaggcccgcaacuccaccuuccugaucgacgggcccgacacgagcgagugcccgaacgagcggcgcgccuggaacuucuucgagguggaggacuacggcuucgggauguucaccaccaacaucuggaugaaguuccgggagggcuccagcgaggugugcgaccaccgccugauguccgccgcgaucaaggaccagaaggccguccacgccgacaugggcuacuggaucgagagcuccaagaaccagaccuggcagaucgagaaggccagccucaucgaggugaagacgugccuguggcccaagacccacacccugugguccaacggggugcucgagagccagaugcugaucccccgguccuacgcgggcccguucagccagcacaacuaccgccagggguacgccacccagaccgccggccccuggcaccuggggaagcucgagaucgacuucggcgagugccccggcacgaccgucaccauccaggaggacugcgaccaccgggggcccucccugcgcaccacgaccgccagcggcaagcuggugacccaguggugcugccgcuccugcaccaugccgccccuccgguuccugggggaggacggcugcugguacgggauggagauccgcccccugagcgagaaggaggagaacauggucaagagccaggucacggccggccagggcaccuccgagaccuucagcauggggcuccugugccugacccucuucguggaggagugccugcggcgccgggucacgcgcaagcacaugauccuggugguggucaucaccuucugcgcgaucauccucggcgggcugaccuggauggaccugcuccgggcccugaucaugcugggcgacaccauguccggccgcaucgggggccagauccaccucgccaucauggccguguucaagaugagccccggguacgugcugggcgucuuccugcggaagcucacgucccgcgagaccgcccugauggugaucgggauggcgaugaccaccguguucagcaucccgcacgaccugauggagcucaucgacggcaucucccugggccugaucauccucaagaucgucacgcacuucgacaacacccagguggggacccuggcccugagccucaccuucauccgguccacgacgccccuggugauggccuggcgcaccaucauggccgucuucuucguggugacccugaucccccucugccggacgagcugccugcagaagcagucccacugggucgagaucaccgcccugauccucggcgcgcaggcccugcccguguaccugaugacccucaugaagggggccagccgccgguccuggccgcugaacgagggcaucauggccguggggcuggucagccuccugggcuccgcgcugcucaagaacgacgugccccuggccggccccaugguggccgggggccugcuccuggccgccuacgucaugagcggguccagcgcggaccugucccucgagaaggccgccaacgugcagugggacgagauggccgacaucaccggcagcagccccaucaucgaggugaagcaggacgaggacggguccuucagcauccgcgacgucgaggagacgaacaugaucacccugcuggugaagcucgcccugaucaccguguccggccuguacccgcucgcgauccccgucaccauggcccugugguacguguggcaggucaagacgcagcggagcggcgcccugugggacguccccucccccgccgccacccagaaggcgacccucagcgaggggguguaccgcaucaugcagcggggccuguucgggaagacccaggugggcgucgggauccacauggagggcguguuccacaccauguggcacgugacgcgcggcuccgucaucugccacgagaccgggcggcuggagccgagcugggccgacgugcgcaacgacaugaucuccuacggcgggggcuggcgccucggcgacaagugggacaaggaggaggacgugcagguccuggccaucgagcccgggaagaaccccaagcacgugcagaccaagcccggccuguucaagacccucacgggggagaucggcgccgugacccuggacuucaagccggggaccagcggcucccccaucaucaacaagaagggcaaggucaucgggcuguacggcaacgggguggugaccaagagcggcgacuacgucuccgccaucacgcaggcggagcggaucggggagcccgacuacgagguggacgaggacaucuuccgcaagaagcggcucaccaucauggaccugcacccgggcgccggcaagaccaagcgcauccugcccagcaucgugcgggaggcccucaagcgccggcugcgcacccugauccucgcccccacgcgggucguggcggccgagauggaggaggcccugcgcgggcugcccauccgguaccagaccccggccgugaaguccgagcacaccggccgcgagaucgucgaccugaugugccacgccaccuucacgacccggcuccugagcuccacccgcgugcccaacuacaaccugaucgucauggacgaggcgcacuucaccgaccccugcagcguggccgcccggggguacaucuccacgcgcguggagaugggcgaggccgccgcgaucuucaugaccgccacgcccccggggagcaucgaccccuucccccagagcaacucccccaucgaggacaucgagcgggagaucccggagcgcagcuggaacaccggcuucgacuggaucacggacuaccagggcaagaccgucugguucgugcccuccaucaaggccgggaacgacaucgccaacugccuccgcaagagcggcaagcgcgugauccagcugucccgcaagaccuucgacaccgaguaccccaagacgaagcugaccgacugggacuucgucgugaccaccgacaucagcgagaugggggccaacuuccgggcgggccgcgugaucgacccccggcgcugccucaagccggucauccugacggacgggcccgagcgggugauccuggccggccccauccccgugaccccggccuccgccgcgcagcgccggggccgcaucgggcggaaccccgcccaggaggacgaccaguacgucuucagcggcgacccccucaagaacgacgaggaccacgcccacuggaccgaggccaagaugcugcuggacaacaucuacacccccgaggggaucaucccgacccucuucggccccgagcgcgagaagacccaggccaucgacggcgaguuccggcugcgcggggagcagcggaagaccuucguggagcugaugcgccggggcgaccuccccguguggcuguccuacaaggucgcgagcgccgggaucuccuacaaggaccgcgaguggugcuucaccggcgagcggaacaaccagauccuggaggagaacauggagguggagaucuggacgcgcgagggggagaagaagaagcuccggcccaaguggcuggacgcccgcguguacgccgacccgauggcccugaaggacuucaaggaguucgcgagcggccggaaguccaucacccucgacauccugaccgagaucgccacccugcccaccuaccucagcuccaaggccaagcuggcccuggacaacaucgucaugcuccacacgaccgagaagggcgggcgcgccuaccagcacgcgcugaacgagcugcccgagagccucgagacccugaugcugguggcccuccugggcgccaugaccgccgggaucuuccuguucuucaugcagggcaaggggaucggcaagcucuccaugggccugaucgcgaucgccguggccagcgggcugcucugggucgccgagauccagccgcaguggaucgccgcguccaucauccuggaguucuuccugauggugcuccugauccccgagcccgagaagcagcgcacgccccaggacaaccagcugaucuacgugauccucaccauccugaccaucaucggccugaucgccgccaacgagauggggcucaucgagaagaccaagacggacuucggcuucuaccaggucaagaccgagaccaccauccuggacguggaccugcggccggccagcgccuggacgcucuacgcgguggccaccaccauccugacccccaugcugcgccacacgaucgagaacaccagcgccaaccucucccuggccgccaucgcgaaccaggccgccguccugauggggcucggcaagggcuggccccugcaccggauggaccugggggugccccuccuggccaugggcugcuacagccaggugaacccgaccacccugacggccucccucgucaugcugcuggugcacuacgcgaucaucgggcccggccuccaggccaaggccacccgcgaggcccagaagcggaccgcggccggcaucaugaagaaccccaccguggacgggaucacggucaucgaccuggagcccaucagcuacgacccgaaguucgagaagcagcugggccaggugaugcuccuggugcugugcgucgggcagcuccugcugaugcgcaccaccugggcccucugcgaggugcugacccuggccacgggccccgugaugacccucugggaggggaaccccggccgguucuggaacaccaccaucgccgucuccacggcgaacaucuuccgcggcagcuaccuggccggggccggccuggccuucucccucaucaagaacgcccagacgccccggcgcgggaccggcaccacgggggagacccugggcgagaaguggaagcggcagcugaacagccucgaccgcaaggaguucgaggaguacaagcgguccggcauccuggagguggaccgcaccgaggccaagagcgcccugcgggacggguccaagaucaaguacgccgugagccgcggcuccagcaagauccgguggaucgucgagcgcgggaugaucaagccgaagggcaaggugguggaccucgggugcggccggggcgggugguccuacuacauggccacccugaagaacgucaccgaggugaagggcuacacgaagggcggccccgggcacgaggagcccauccccauggccaccuacggcuggaaccuggugaagcuccacagcggcgucgacguguucuacaagccgaccgagcaggucgacacccugcugugcgacaucggggaguccagcuccaaccccacgaucgaggagggccgcacccuccgcguccugaagaugguggagcccuggcugagcagcaagcccgaguucugcaucaagguccucaacccguacaugcccaccgugaucgaggagcuggagaagcugcagcggcgccacgggggcucccucgugcggugcccccugagccgcaacuccacccacgagauguacugggucagcggcgcguccgggaacaucgugagcuccgugaacacgaucagcaagaugcugcugaaccgguucaccacccgccaccggaagcccaccuacgagaaggacgucgaccucggcgccgggacgcgcuccgugagcaccgagaccgagaagccggacaugaccaucaucggccggcgccugcagcggcugcgcgaggagcacaaggagacguggcacuacgaccaggagaaccccuaccggaccugggccuaccacggguccuacgaggcccccagcaccggcuccgcgagcuccauggugaacggcgucgugaagcuccugaccaagccgugggacgugauccccauggucacgcagcuggccaugaccgacaccacccccuucgggcagcagcgcguguucaaggagaagguggacacgcggacgccccagccgaagcccggcacccgcaugaucaugaccacgaccgccaacuggcucugggcccugcuggggaagaagaaguccccgcggcucugcacccgcgaggaguucaucuccaagguccggagcaacgccgcgaucggcgccguguuccaggaggagcagggguggaccuccgccagcgaggccgugaacgacagccgcuucugggagcuggucgacaaggagcgggcccugcaccaggagggcaagugcgaguccugcguguacaacaugaugggcaagcgcgagaagaagcucggggaguucggccgcgcgaaggggagccgggccaucugguacauguggcugggcgcccgcuuccuggaguucgaggcccucggguuccugaacgaggaccacugguucucccgggagaacagcugguccggcguggagggcgaggggcugcaccgccucggcuacauccuggaggacaucgacaagaaggacggggaccugaucuacgccgacgacacggcgggcugggacacccggaucaccgaggacgaccuccugaacgaggagcugaucaccgagcagauggcgccccaccacaagacgcucgccaaggccaucuucaagcugaccuaccagaacaaggucgugaaggugcugcgccccacccccaagggcgcggucauggacaucaucagccggaaggaccagcgcggguccggccagguggggaccuacggccucaacaccuucacgaacauggaggugcagcugauccggcagauggaggccgagggggucaucacccaggacgacaugcagaaccccaagggccugaaggagcgcguggagaaguggcucaaggagugcggcguggaccggcugaagcgcauggccaucagcggggacgacugcgucgugaagccccuggacgagcgguucuccaccagccuccuguuccugaacgacaugggcaaggugcgcaaggacaucccgcagugggagcccuccaagggguggaagaacuggcaggagguccccuucugcagccaccacuuccacaagaucuucaugaaggacggccggucccucguggugcccugccgcaacccggacgagcugaucgggcgggcccgcaucagccagggcgccggcuggucccugcgggagaccgcgugccucgggaaggccuacgcccagauguggagccugauguacuuccaccgccgcgaccugcggcucgccuccauggccaucugcagcgcgguccccacggagugguuccccaccagccgcaccaccugguccauccacgcccaccaccaguggaugacgaccgaggacaugcugaagguguggaaccggguguggaucgaggacaaccccaacaugaccgacaagaccccgguccacagcugggaggacauccccuaccugggcaagcgcgaggaccucuggugcgggucccugaucggccugagcucccgggccacgugggccaagaacauccacaccgccaucacccaggugcgcaaccucaucgggaaggaggaguacguggacuacaugcccgcgaugaagcgguacagcgcccccuucgaguccgagggcguccuguga

SEQ ID NO: 10490 - RNA, 9867 nt, Artificial Sequence
  derived and/or modified CDS sequence (opt1) from DENV-4__KC762697__SS-prME
agcaccaugacccugcucugccugauccccaccgccauggccuuccaccugagcacccgggacggcgagccgcucaugaucguggcgaagcacgagcgggggcgcccccugcuguucaagaccaccgagggcaucaacaagugcacccucaucgccauggaccugggggagaugugcgaggacaccgugaccuacaagugcccccugcucgugaacaccgagcccgaggacaucgacugcuggugcaaccugacgagcaccugggugauguacgggaccugcacccaguccggggagcggcgccgggagaagcgcagcguggcccugacgccgcacuccggcaugggccucgagacccgggccgagaccuggaugagcuccgagggggccuggaagcacgcgcagcgcguggagagcuggauccugcggaaccccggcuucgcccugcucgccggguucauggccuacaugaucggccagaccgggauccagcgcacgguguucuucguccugaugaugcugguggcgcccuccuacggcaugcggugcgugggcgucgggaaccgcgacuucguggagggcgugagcgggggcgccugggucgaccucgugcuggagcacggcgggugcgugaccaccauggcccagggcaagcccacccuggacuucgagcucacgaagaccaccgccaaggaggucgcccugcugcggaccuacugcaucgaggcguccaucagcaacaucacgaccgccacccgcugcccgacccagggggagcccuaccucaaggaggagcaggaccagcaguacaucugccggcgcgacgugguggaccggggcugggggaacggcugcggccuguucgggaagggcggggucgugacgugcgccaaguuccugugcuccggcaagaucaccgggaaccucgugcagaucgagaaccuggaguacaccgucguggugaccguccacaacggcgacacgcacgccgugggcaacgacaccagcaaccacggggucaccgccaccaucacgccccgcucccccagcguggaggugaagcugccggacuacggcgagcucacccuggacugcgagccccgguccgggaucgacuucaacgagaugauccugaugaagaugaagaagaagaccuggcucguccacaagcagugguuccuggaccugccccuccccuggaccgcgggcgccgacaccagcgaggugcacuggaacuacaaggagcgcauggugacguucaaggucccgcacgccaagcggcaggacgugaccgugcuggggucccaggagggcgccaugcacagcgcccuggcgggcgccaccgaggucgacagcggggacggcaaccacauguucgccgggcaccucaagugcaaggugcgcauggagaagcugcgcaucaagggcauguccuacaccaugugcagcggcaaguucuccaucgacaaggagauggccgagacgcagcacgggaccaccguggucaaggugaaguacgagggcgccggggcgcccugcaaggugcccaucgagauccgggacgucaacaaggagaagguggugggccgcaucaucagcuccacccccuucgccgagaacacgaacagcgucaccaacaucgagcuggagccgcccuucggggacuccuacaucgugaucggcgugggcgacagcgcccucacccugcacugguuccggaagggguccagcaucggcaagauguucgaguccaccuaccgcggggccaagcggauggcgauccugggcgagacggccugggacuucgggagcgucggcggccucuucaccucccuggggaaggccgugcaccagguguucggcagcgucuacaccaccauguucgggggcguguccuggaugauccgcauccugaucgggcuccuggugcuguggaucggcacgaacagccggaacaccuccauggccaugaccugcaucgccgucggcgggaucacccuguuccucggcuucacggugcaggcggacauggggugcguggucagcuggaacggcaaggagcugaagugcggguccggcaucuucgugguggacaacguccacaccuggaccgagcaguacaaguuccagcccgagagccccgcccgccuggccagcgccauccucaacgcccacaaggacggcgugugcgggauccgguccaccacgcgccuggagaacgugauguggaagcagaucaccaacgagcugaacuacguccucugggagggcgggcacgaccugaccgugguggcgggcgacgucaagggcgugcugaccaaggggaagcgggugcucacgccgcccgucaacgaccugaaguacagcuggaagaccuggggcaaggccaagaucuucacccccgaggcccgcaacuccaccuuccugaucgacgggcccgacacgagcgagugcccgaacgagcggcgcgccuggaacuucuucgagguggaggacuacggcuucgggauguucuccaccaacaucuggaugaaguuccgggagggcagcuccgaggugugcgaccaccgccucaugagcgccgcgaucaaggaccagaaggccguccacgccgacaugggcuacuggaucgaguccagcaagaaccagaccuggcagaucgagaaggccucccugaucgaggugaagaccugccuguggcccaagacgcacacccucuggagcaacggggugcuggagucccagaugcugaucccccggagcuacgcgggcccguucucccagcacaacuaccgccagggguacgccacccagaucgccggccccuggcaccucgggaagcuggagaucgacuucggcgagugccccggcaccaccgucacgauccaggaggacugcgaccaccgggggcccagccugcgcaccaccaccgccuccggcaagcucgugacgcaguggugcugccgcagcugcaccaugccgccccugcgguuccugggggaggacggcugcugguacgggauggagauccgcccccucagcgagaaggaggagaacauggugaagucccaggucaccgccggccagggcaccagcgagacguucuccauggggcugcugugccucacccuguucguggaggagugccugcggcgccgggucacccgcaagcacaugauccucgugguggcgaucaccuucugcgccaucauccugggcgggcugacguggauggaccuccugcgggcccugaucaugcucggcgacaccaugagcggccgcaucgggggccagauccaccuggccaucauggccgucuucaagaugucccccggguacgugcugggcguguuccuccggaagcugaccagccgcgagaccgcgcugauggucaucgggauggccaugacgaccguguucuccaucccgcacgaccucauggagcugaucgacggcaucagccugggccucauccugcugaagaucgugacccacuucgacgacacccaggucgggacgcucgcccugucccugaccuucauccggagcaccacgccccuggugauggccuggcgcacgaucauggccguguucuucauggucacccugaucccccugugccggaccuccugccuccagaagcagagccacuggguggagaucaccgcgcugauccugggcgcccaggcccuccccguguaccugaugacgcugaugaagggggccucccgccggagcuggccgcucaacgagggcaucauggcggucgggcuggugucccugcucggcagcgcccugcugaagaacgacgugccccucgccggccccauggucgccgggggccugcugcucgccgcguacgugauguccgggagcuccgccgaccugagccuggagaaggccgccaacgugcagugggacgagauggccgacaucaccggcagcucccccaucaucgaggucaagcaggacgaggacgggagcuucuccauccgcgacguggaggagaccaacaugaucacccuccuggugaagcuggcgcucaucacggucagcggccuguacccgcuggccauccccgugaccauggcccucugguacaucuggcaggucaagacccagcgguccggcgcccugugggacguccccagccccgccgcgacccagaaggccacgcuguccgaggggguguaccgcaucaugcagcggggccucuucgggaagacccaggugggcgucgggauccacauggagggcguguuccacaccauguggcacgugacccgcggcagcgucaucugccacgagaccgggcggcuggagccguccugggccgacgugcgcaacgacaugaucagcuacggcgggggcuggcgccugggcgacaagugggacaaggaggaggacgugcagguccucgccaucgagcccgggaagaaccccaagcacgugcagacgaagcccggccuguucaagacccugaccggggagaucggcgccgugacccucgacuucaagccggggacguccggcagccccaucaucaacaagaagggcaaggucaucgggcuguacggcaacgggguggugaccaaguccggcgacuacgucagcgcgaucacccaggccgagcggaucggggagcccgacuacgagguggacgaggacaucuuccgcaagaagcggcugaccaucauggaccuccacccgggcgccggcaagacgaagcgcauccugcccuccaucgugcgggaggcccugaagcgccggcuccgcacccugauccuggcgcccacccgggucguggccgccgagauggaggaggcccugcgcgggcuccccauccgguaccagaccccggccgugaaggcggagcacacgggccgcgagaucgucgaccugaugugccacgccaccuucaccacccggcugcucagcuccacgcgcgugcccaacuacaaccugaucgugauggacgaggcccacuucaccgaccccugcagcgucgccgcccggggguacaucuccacccgcguggagaugggcgaggcggccgccaucuucaugaccgccacgcccccggggagcaccgaccccuucccccagagcaacucccccaucgaggacaucgagcgggagaucccggagcgcagcuggaacaccggcuucgacuggaucaccgacuaccagggcaagacggucugguucgugcccuccaucaaggccgggaacgacaucgcgaacugccugcgcaagagcggcaagcgcgugauccagcucucccgcaagaccuucgacaccgaguaccccaagaccaagcugacggacugggacuucgucgugaccaccgacaucagcgagaugggggccaacuuccgggccggccgcgugaucgacccccggcgcugccugaagccggucauccucaccgacgggcccgagcgggugauccuggccggccccauccccgugacgccggcguccgccgcccagcgccggggccgcaucgggcggaaccccgcccaggaggacgaccaguacgucuucagcggcgacccccugaagaacgacgaggaccacgcccacuggaccgaggcgaagaugcuccuggacaacaucuacacccccgaggggaucaucccgacccuguucggccccgagcgcgagaagacgcaggccaucgacggcgaguuccggcuccgcggggagcagcggaagaccuucguggagcugaugcgccggggcgaccugcccguguggcucuccuacaaggucgccagcgccgggaucuccuacaaggaccgcgaguggugcuucaccggcgagcggaacaaccagauccuggaggagaacauggagguggagaucuggacccgcgagggggagaagaagaagcugcggcccaaguggcucgacgcccgcguguacgcggacccgauggcccugaaggacuucaaggaguucgccagcggccggaaguccaucacgcuggacauccucaccgagaucgccacccugcccaccuaccugagcuccaaggccaagcucgcgcuggacaacaucgucaugcugcacaccacggagaagggcgggcgcgccuaccagcacgcccucaacgagcugcccgagagccuggagacccucaugcugguggcccugcucggcgcgaugaccgccgggaucuuccuguucuucaugcagggcaaggggaucggcaagcuguccaugggccucaucgccaucgccguggccagcgggcugcugugggucgcggagauccagccgcaguggaucgccgccuccaucauccucgaguucuuccugauggugcugcucauccccgagcccgagaagcagcgcacgccccaggacaaccagcugaucuacgugauccugacgauccucaccaucaucggccugaucgccgccaacgagauggggcugaucgagaagaccaagaccgacuucggcuucuaccaggcgaagacggagaccaccauccucgacgucgaccugcggccggccagcgccuggacccuguacgccguggccacgaccauccucacccccaugcugcgccacaccaucgagaacacgagcgcgaaccugucccucgccgccaucgccaaccaggccgcggugcugauggggcugggcaagggcuggccccuccaccggauggaccugggggucccccugcucgccaugggcugcuacagccaggugaacccgaccacccugaccgccucccuggugaugcuccugguccacuacgccaucaucgggcccggccugcaggcgaaggccacgcgcgaggcccagaagcggaccgccgccggcaucaugaagaaccccaccguggacgggaucaccgugaucgaccucgagcccaucagcuacgacccgaaguucgagaagcagcugggccaggucaugcugcucgugcugugcguggggcagcugcuccugaugcgcacgaccugggcgcugugcgagguccucacccuggccaccggccccaucaugacgcugugggaggggaaccccggccgguucuggaacaccaccaucgccguguccaccgccaacaucuuccgcggcagcuaccucgccggggcgggccuggccuucucccugaucaagaacgcccagacgccccggcgcgggaccggcaccaccggggagacgcucggcgagaaguggaagcggcagcugaacagccuggaccgcaaggaguucgaggaguacaagcgguccggcauccucgagguggaccgcaccgaggccaagagcgcccugcgggacggguccaagaucaaguacgcggucagccgcggcuccagcaagauccgguggaucguggagcgcgggauggugaagccgaagggcaaggucguggaccuggggugcggccggggcgggugguccuacuacauggccacccucaagaacgugaccgaggucaagggcuacaccaagggcggccccgggcacgaggagcccauccccauggccacguacggcuggaaccuggugaagcugcacagcggcguggacgucuucuacaagccgaccgagcaggucgacacccuccugugcgacaucggggaguccagcuccaaccccaccaucgaggagggccgcacgcugcgcgugcucaagauggucgagcccuggcugagcagcaagcccgaguucugcaucaaggugcugaacccguacaugcccaccgugaucgaggagcucgagaagcugcagcggcgccacgggggcucccugguccggugcccccugagccgcaacuccacccacgagauguacugggugagcggcgccuccgggaacaucgucagcuccgugaacaccaucagcaagaugcuccugaaccgguucacgacccgccaccggaagcccaccuacgagaaggacguggaccugggcgcggggacccgcuccgucagcacggagaccgagaagccggacaugaccaucaucggccggcgccuccagcggcugcgcgaggagcacaaggagaccuggcacuacgaccaggagaaccccuaccggacgugggccuaccacggguccuacgaggcccccagcaccggcuccgccagcuccauggugaacggcguggucaagcugcucaccaagccgugggacgugauccccauggugacccagcuggccaugacggacaccacccccuucgggcagcagcgcgucuucaaggagaagguggacacccggacgccccagccgaagcccggcacccgcaugaucaugaccaccacggcgaacuggcugugggcccuccuggggaagaagaaguccccgcggcugugcacccgcgaggaguucaucuccaaggugcggagcaacgccgccaucggcgccgucuuccaggaggagcagggguggaccuccgcgagcgaggccgugaacgacagccgcuucugggagcucguggacaaggagcgggcccugcaccaggagggcaagugcgaguccugcgucuacaacaugaugggcaagcgcgagaagaagcugggggaguucggccgcgccaaggggagccgggccaucugguacauguggcucggcgcgcgcuuccuggaguucgaggcccugggguuccucaacgaggaccacugguucucccgggagaacagcugguccggcguggagggcgaggggcugcaccgccugggcuacauccucgaggacaucgacaagaaggacggggaccugaucuacgccgacgacaccgccggcugggacacgcggaucaccgaggacgaccugcucaacgaggagcugaucaccgagcagauggcgccccaccacaagacccuggccaaggccaucuucaagcucacguaccagaacaagguggucaaggugcugcgccccacccccaagggcgccgugauggacaucaucagccggaaggaccagcgcggguccggccaggucgggaccuacggccugaacaccuucaccaacauggaggugcagcucauccggcagauggaggccgagggggugaucacgcaggacgacaugcagaaccccaagggccuggaggagcgcgucgagaaguggcugaaggagugcggcguggaccggcucaagcgcauggcgaucagcggggacgacugcguggucaagccccuggacgagcgguucuccaccagccuccucuuccugaacgacaugggcaaggugcgcaaggacaucccgcagugggagcccuccaagggguggaagaacuggcaggaggugcccuucugcagccaccacuuccacaagaucuucaugaaggacggccggucccuggucgugcccugccgcaaccaggacgagcucaucgggcgggcccgcaucagccagggcgccggcuggucccugcgggagaccgccugccuggggaaggccuacgcgcagauguggagccucauguacuuccaccgccgcgaccugcggcuggccuccauggccaucugcagcgccgugccgaccgagugguuccccacgagccgcaccaccugguccauccacgcccaccaccaguggaugaccacggaggacaugcucaaggucuggaaccggguguggaucgaggacaaccccaacaugaccgacaagacccccauccacagcugggaggacaucccguaccugggcaagcgcgaggaccuguggugcgggucccucaucggccugagcucccgggcgaccugggccaagaacauccacacggccaucacccaggugcgcaaccugaucgggaaggaggaguacgucgacuacaugcccgugaugaagcgguacagcgcccccuccgagagcgagggcgugcucuga

SEQ ID NO: 10491 - RNA, 9867 nt, Artificial Sequence
  derived and/or modified CDS sequence (opt1) from DENV-4__KC762698__SS-prME
agcaccaugacccugcucugccugauccccaccgugauggccuuccaccugagcacccgggacggcgagccgcucaugaucguggccaagcacgagcgggggcggccccugcuguucaagaccaccgagggcaucaacaagugcacccucaucgccauggaccugggggagaugugcgaggacaccgugaccuacaagugcccccugcucgugaacaccgagcccgaggacaucgugugcuggugcaaccugaccagcaccugggugauguacgggaccugcacccaguccggggagcggcgccgggagaagcgcagcguggcccugacgccgcacuccggcaugggccucgagacccgggccgagaccuggaugagcuccgagggggccuggaagcacgcccagcgcguggagagcuggauccugcggaaccccggcuucgcgcugcucgccggguucauggccuacaugaucggccagaccgggauccagcgcacgguguucuucgugcugaugaugcuggucgcccccuccuacggcaugcggugcgugggcguggggaaccgcgacuucgucgagggcgugagcgggggcgcguggguggaccucguccuggagcacggcgggugcgugaccaccauggcccagggcaagcccacccuggacuucgagcucacgaagaccaccgccaaggagguggcccugcugcggaccuacugcaucgaggccuccaucagcaacaucacgaccgcgacccgcugcccgacccagggggagcccuaccucaaggaggagcaggaccagcaguacaucugccggcgcgacgucguggaccggggcugggggaacggcugcggccuguucgggaagggcgggguggucacgugcgccaaguuccugugcuccggcaagaucaccgggaaccucgugcagaucgagaaccuggaguacaccguggucgugaccguccacaacggcgacacgcacgccgugggcaacgacaccagcaaccacggggugaccgccaccaucacgccccgcucccccagcgucgaggugaagcugccggacuacggcgagcucacccuggacugcgagccccgguccgggaucgacuucaacgagaugauccugaugaagaugaagaagaagaccuggcucgugcacaagcagugguuccuggaccugccccuccccuggaccgccggcgcggacaccagcgagguccacuggaacuacaaggagcgcauggugacguucaaggugccgcacgccaagcggcaggacgucaccgugcuggggucccaggagggcgccaugcacagcgcccuggccggcgcgaccgagguggacagcggggacggcaaccacauguucgccgggcaccucaagugcaagguccgcauggagaagcugcgcaucaagggcauguccuacaccaugugcagcggcaaguucuccaucgacaaggagauggccgagacgcagcacgggaccaccguggugaaggucaaguacgagggcgccggggcccccugcaaggugcccaucgagauccgggacgugaacaaggagaaggucgugggccgcaucaucagcuccacccccuucgcggagaacacgaacagcgugaccaacaucgagcuggagccgcccuucggggacuccuacaucgucaucggcgccggcgacagcgcccucacccugcacugguuccggaagggguccagcaucggcaagauguucgaguccaccuaccgcggggccaagcggauggcgauccugggcgagacggccugggacuucgggagcgugggcggccucuucaccucccuggggaaggccgugcaccaggucuucggcagcguguacaccaccauguucgggggcguguccuggaugauccgcauccugaucggguuccucguccuguggaucggcacgaacagccggaacaccuccauggccaugaccugcaucgccgugggcgggaucacccuguuccugggcuucacggugcaggcggacauggggugcgucgugagcuggaacggcaaggagcucaagugcggguccggcaucuucguggucgacaacgugcacaccuggaccgagcaguacaaguuccagcccgagagccccgcccgccuggccagcgccauccugaacgcccacaaggacggcgugugcgggauccgguccaccacgcgccucgagaacgucauguggaagcagaucaccaacgagcugaacuacgugcugugggagggcgggcacgaccucaccguggucgcgggcgacgugaagggcgugcugaccaaggggaagcgggcccugacgccgcccgucaacgaccucaaguacagcuggaagaccuggggcaaggccaagaucuucacccccgaggcccgcaacuccaccuuccugaucgacgggcccgacacgagcgagugcccgaacgagcggcgcgccuggaacuucuucgagguggaggacuacggcuucgggauguucaccaccaacaucuggaugaaguuccgggagggcuccagcgaggugugcgaccaccgccugauguccgcggccaucaaggaccagaaggccguccacgccgacaugggcuacuggaucgagagcuccaagaaccagaccuggcagaucgagaaggcgagccucaucgaggugaagacgugccuguggcccaagacccacacccugugguccaacggggugcucgagagccagaugcugaucccccgguccuacgccggcccguucagccagcacaacuaccgccagggguacgccacccagaccgccggccccuggcaccuggggaagcucgagaucgacuucggcgagugccccggcacgaccgucaccauccaggaggacugcgaccaccgggggcccucccugcgcaccacgaccgccagcggcaagcuggugacccaguggugcugccgcuccugcaccaugccgccccuccgguuccugggggaggacggcugcugguacgggauggagauccgcccccugagcgagaaggaggagaacauggucaagagccaggucacggcgggccagggcaccuccgagaccuucagcauggggcuccugugccugacccucuucguggaggagugccugcggcgccgggucacgcgcaagcacaugauccuggugguggucaucaccuucugcgccaucauccucggcgggcugaccuggauggaccugcuccgggcccugaucaugcugggcgacaccauguccggccgcaucgggggccagauccaccucgccaucauggccguguucaagaugagccccggguacgugcugggcgucuuccugcggaagcucacgucccgcgagaccgcgcugauggugaucgggauggccaugaccaccguguucagcaucccgcacgaccugauggagcucaucgacggcaucucccugggccugauccuccugaagaucgucacgcacuucgacaacacccagguggggacccuggcccucagccugaccuucauccgguccacgacgccccuggugauggccuggcgcaccaucauggccgucuucuucguggugacccucaucccccugugccggacgagcugccugcagaagcagucccacugggucgagaucaccgcgcucauccugggcgcccaggcccugcccguguaccucaugacccugaugaagggggccagccgccgguccuggccgcugaacgagggcaucauggcgguggggcucgucagccugcugggcuccgcccuccugaagaacgacgugccccuggccggccccaugguggccgggggccuccugcuggccgcguacgucaugagcggguccagcgccgaccucucccuggagaaggccgccaacgugcagugggacgagauggccgacaucaccggcagcagccccaucaucgaggugaagcaggacgaggacggguccuucagcauccgcgacgucgaggagacgaacaugaucacccugcucgugaagcuggcgcugaucaccguguccggccucuacccgcuggccauccccgucaccauggcccugugguacguguggcaggucaagacgcagcggagcggcgcccucugggacguccccucccccgccgcgacccagaaggccacccugagcgaggggguguaccgcaucaugcagcggggccuguucgggaagacccaggugggcgucgggauccacauggagggcguguuccacaccauguggcacgugacgcgcggcuccgucaucugccacgagaccgggcggcucgagccgagcugggccgacgugcgcaacgacaugaucuccuacggcgggggcuggcgccugggcgacaagugggacaaggaggaggacgugcagguccuggccaucgagcccgggaagaaccccaagcacgugcagaccaagcccggccucuucaagacccugacgggggagaucggcgccgugacccuggacuucaagccggggaccagcggcucccccaucaucaacaagaagggcaaggucaucgggcucuacggcaacgggguggugaccaagagcggcgacuacgucuccgcgaucacgcaggccgagcggaucggggagcccgacuacgagguggacgaggacaucuuccgcaagaagcggcugaccaucauggaccugcacccgggcgccggcaagaccaagcgcauccuccccagcaucgugcgggaggcccugaagcgccggcugcgcacccucauccuggcgcccacgcgggucguggccgccgagauggaggaggcccugcgcgggcugcccauccgguaccagaccccggccgugaaguccgagcacaccggccgcgagaucgucgaccucaugugccacgcgaccuucacgacccggcugcugagcuccacccgcgugcccaacuacaaccucaucgucauggacgaggcccacuucaccgaccccugcagcguggccgcccggggguacaucuccacgcgcguggagaugggcgaggccgcggccaucuucaugaccgccacgcccccggggagcaucgaccccuucccccagagcaacucccccaucgaggacaucgagcgggagaucccggagcgcagcuggaacaccggcuucgacuggaucacggacuaccagggcaagaccgucugguucgugcccuccaucaaggccgggaacgacaucgccaacugccugcgcaagagcggcaagaaggugauccagcugucccgcaagaccuucgacaccgaguaccccaagacgaagcucaccgacugggacuucgucgugaccaccgacaucagcgagaugggggcgaacuuccgcgccggccgggugaucgacccccgccggugccugaagccggucauccugacggacgggcccgagcgcgugauccucgccggccccauccccgugaccccggccuccgcggcccagcggcgcggccggaucgggcgcaaccccgcccaggaggacgaccaguacgucuucagcggcgacccccugaagaacgacgaggaccacgcccacuggaccgaggccaagaugcugcucgacaacaucuacacccccgaggggaucaucccgacgcuguucggccccgagcgggagaagacccaggcgaucgacggcgaguuccgccugcgcggggagcagcgcaagaccuucguggagcucaugcggcgcggcgaccugcccguguggcuguccuacaaggucgccagcgccgggaucuccuacaaggaccgggaguggugcuucaccggcgagcgcaacaaccagauccucgaggagaacauggagguggagaucuggacgcgggagggggagaagaagaagcugcgccccaaguggcuggacgcccggguguacgccgacccgauggcgcucaaggacuucaaggaguucgccagcggccgcaaguccaucacccuggacauccugaccgagaucgccacccuccccaccuaccugagcuccaaggccaagcuggcccucgacaacaucgucaugcugcacacgaccgagaagggcgggcgggcguaccagcacgcccugaacgagcuccccgagagccuggagacccugaugcucguggcccugcugggcgccaugaccgcggggaucuuccucuucuucaugcagggcaaggggaucggcaagcuguccaugggccugaucgccaucgccguggccagcgggcuccugugggucgccgagauccagccgcaguggaucgcggccuccaucauccuggaguucuuccucauggugcugcugauccccgagcccgagaagcagcgcacgccccaggacaaccagcucaucuacgugauccugaccauccugaccaucaucggccucaucgccgccaacgagauggggcugaucgagaagaccaagacggacuucggcuucuaccaggucaagaccgagaacaccauccuggacguggaccuccgcccggccagcgcguggacccuguacgccguggccacgaccauccugacccccaugcuccggcacaccaucgagaacacgagcgccaaccugucccuggccgcgaucgccaaccaggccgccguccucauggggcugggcaagggcuggccccugcaccgcauggaccucggggugccccugcuggccaugggcugcuacagccaggugaacccgaccacccucaccgcgucccuggucaugcugcucgugcacuacgccaucaucgggcccggccugcaggccaaggccacgcgggaggcgcagaagcgcaccgccgccggcaucaugaagaaccccaccguggacgggaucaccgucaucgaccuggagcccaucagcuacgacccgaaguucgagaagcagcucggccaggugaugcugcuggugcucugcgucgggcagcugcugcucaugcggacgaccugggcccugugcgaggugcugacccucgccaccggccccgugaugacgcugugggaggggaaccccggccgcuucuggaacaccaccaucgcggucuccaccgccaacaucuuccggggcagcuaccuggccggggccggccucgccuucucccugaucaagaacgcgcagacgccccgccgggggaccggcaccaccggggagacgcugggcgagaaguggaagcgccagcucaacagccuggaccggaaggaguucgaggaguacaagcgcuccggcauccuggagguggaccggaccgaggccaagagcgcccuccgcgacggguccaagaucaaguacgccgugagccggggcuccagcaagauccgcuggaucgucgagcgggggaugaucaagccgaagggcaaggugguggaccuggggugcggccgcggcgggugguccuacuacauggccacccugaagaacgucaccgaggugaagggcuacaccaagggcggccccgggcacgaggagcccauccccauggcgacguacggcuggaaccucgugaagcugcacagcggcgucgacguguucuacaagccgaccgagcaggucgacacccugcucugcgacaucggggaguccagcuccaaccccaccaucgaggagggccggacgcugcgcguccugaagaugguggagcccuggcucagcagcaagcccgaguucugcaucaagguccugaacccguacaugcccaccgugaucgaggagcuggagaagcuccagcgccggcacgggggcucccuggugcgcugcccccugagccggaacuccacccacgagauguacugggucagcggcgccuccgggaacaucgugagcuccgugaacaccaucagcaagaugcugcucaaccgcuucacgacccggcaccgcaagcccaccuacgagaaggacgucgaccugggcgccgggacccgguccgugagcacggagaucgagaagccggacaugaccaucaucggccgccggcugcagcgccuccgggaggagcacaaggagaccuggcacuacgaccacgagaaccccuaccgcaccugggccuaccacggguccuacgaggcgcccagcacgggcuccgccagcuccauggugaacggcaucgucaagcugcugaccaagccgugggacgugauccccauggugacccagcucgccaugaccgacacgacccccuucgggcagcagcgggucuucaaggagaagguggacacccgcacgccccagccgaagcccggcacgcggaugaucaugaccaccaccgccaacuggcugugggcccugcucgggaagaagaaguccccgcgccugugcacgcgggaggaguucaucuccaaggugcgcagcaacgcggccaucggcgccgucuuccaggaggagcagggguggaccuccgccagcgaggccgugaacgacagccgguucugggagcugguggacaaggagcgcgcgcuccaccaggagggcaagugcgaguccugcgucuacaacaugaugggcaagcgggagaagaagcugggggaguucggccgcgccaaggggagccgcgccaucugguacauguggcugggcgcccgguuccucgaguucgaggcccugggguuccugaacgaggaccacugguucucccgcgagaacagcugguccggcguggagggcgaggggcuccaccggcugggcuacauccuggaggacaucgacaagaaggacggggaccucaucuacgcggacgacaccgccggcugggacacccgcaucacggaggacgaccugcugaacgaggagcucaucaccgagcagauggcgccccaccacaagacccuggccaaggcgaucuucaagcugaccuaccagaacaagguggucaaggugcuccggcccacgcccaagggcgccgugauggacaucaucagccgcaaggaccagcggggguccggccaggucgggaccuacggccugaacaccuucaccaacauggaggugcagcugauccgccagauggaggccgagggggugaucacccaggacgacaugcagaaccccaagggccucaaggagcgggucgagaaguggcugaaggagugcggcguggaccgccuggagcggauggccaucagcggggacgacugcguggucaagccccucgacgagcgcuucuccacgagccugcuguuccucaacgacaugggcaaggugcggaaggacaucccgcagugggagcccuccaagggguggaagaacuggcaggaggugcccuucugcagccaccacuuccacaagaucuucaugaaggacggccgcucccuggucgugcccugccggaaccaggacgagcugaucgggcgcgcccggaucagccagggcgcgggcuggucccuccgcgagaccgccugccuggggaaggccuacgcccagauguggcugcucauguacuuccaccggcgcgaccugcgccuggccagcauggcgaucugcuccgccgugccgaccgagugguuccccaccagccggacgaccuggagcauccacgcccaccaccaguggaugaccaccgaggacaugcucaaggucuggaaccgcguguggaucgaggacaaccccaacaugacggacaagacccccgugcacuccugggaggacaucccguaccugggcaagcgggaggaccuguggugcgggagccucaucggccuguccagccgcgccaccugggccaagaacauccacaccgcgaucacgcagguccggaaccugaucgggaaggaggaguacguggacuacaugcccgccaugaagcgcuacuccgcccccuucgagagcgagggcgugcucuga

SEQ ID NO: 10492 - RNA, 9867 nt, Artificial Sequence
  derived and/or modified CDS sequence (opt1) from DENV-4__KC762699__SS-prME
agcaccaugacccugcucugccugauccccaccgugauggccuuccaccugagcacccgggacggcgagccgcucaugaucguggccaagcacgagcgggggcgcccccugcuguucaagaccaccgagggcaucaacaagugcacccucaucgcgauggaccugggggagaugugcgaggacaccgugaccuacaagugcccccugcucgugaacaccgagcccgaggacaucgacugcuggugcaaccugaccagcaccugggugauguacgggaccugcacccaguccggggagcggcgccgggagaagcgcagcguggcccugaccccgcacuccggcaugggccucgagacccgggccgagaccuggaugagcuccgagggggccuggaagcacgcccagcgcguggagagcuggauccugcggaaccccggcuucgcgcugcucgccggguucauggccuacaugaucggccagaccgggauccagcgcacgguguucuucgugcugaugaugcugguggcccccuccuacggcaugcggugcgucggcguggggaaccgcgacuucguggagggcgucagcgggggcgcguggguggaccucgugcuggagcacggcgggugcgucaccaccauggcccagggcaagcccacccuggacuucgagcucacgaagaccaccgccaaggagguggcccugcugcggaccuacugcaucgaggccuccaucagcaacaucacgaccgcgacccgcugcccgacccagggggagcccuaccucaaggaggagcaggaccagcaguacaucugccggcgcgacguggucgaccggggcugggggaacggcugcggccuguucgggaagggcgggguggugacgugcgccaaguuccugugcuccggcaagaucaccgggaaccucguccagaucgagaaccuggaguacaccgugguggucaccgugcacaacggcgacacgcacgccgucggcaacgacaccagcaaccacggggugaccgccaccaucacgccccgcucccccagcguggaggucaagcugccggacuacggcgagcucacccuggacugcgagccccgguccgggaucgacuucaacgagaugauccugaugaagaugaagaagaagaccuggcucgugcacaagcagugguuccuggaccugccccuccccuggaccgccggcgcggacaccagcgaggugcacuggaacuacaaggagcgcauggucacguucaaggugccgcacgccaagcggcaggacgugaccguccuggggucccaggagggcgccaugcacagcgcccuggccggcgcgaccgagguggacagcggggacggcaaccacauguucgccgggcaccucaagugcaaggugcgcauggagaagcugcgcaucaagggcauguccuacaccaugugcagcggcaaguucuccaucgacaaggagauggccgagacgcagcacgggaccaccgucgugaaggugaaguacgagggcgccggggcccccugcaagguccccaucgagauccgggacgugaacaaggagaagguggucggccgcaucaucagcuccacccccuucgcggagaacacgaacagcgugaccaacaucgagcuggagccgcccuucggggacuccuacaucgugaucggcgucggcgacagcgcccucacccugcacugguuccggaagggguccagcaucggcaagauguucgaguccaccuaccgcggggccaagcggauggccauccugggcgagacggcgugggacuucgggagcgugggcggccucuucaccucccuggggaaggccgugcaccaggucuucggcagcguguacaccaccauguucgggggcguguccuggaugauccgcauccugaucggguuccucguccuguggaucggcacgaacagccggaacaccuccauggccaugaccugcaucgccgugggcgggaucacccuguuccugggcuucacggugcaggccgacauggggugcgucgugagcuggaacggcaaggagcucaagugcggguccggcaucuucguggucgacaacgugcacaccuggaccgagcaguacaaguuccagcccgagagccccgcgcgccuggccagcgccauccugaacgcccacaaggacggcgugugcgggauccgguccaccacgcgccucgagaacgucauguggaagcagaucaccaacgagcugaacuacgugcugugggagggcgggcacgaccucaccguggucgccggcgacgugaagggcgugcugaccaaggggaagcgggcgcugacgccgcccgucaacgaccucaaguacagcuggaagaccuggggcaaggccaagaucuucacccccgaggcccgcaacuccaccuuccugaucgacgggcccgacacgagcgagugcccgaacgagcggcgcgccuggaacuucuucgagguggaggacuacggcuucgggauguucaccaccaacaucuggaugaaguuccgggagggcuccagcgaggugugcgaccaccgccugauguccgccgcgaucaaggaccagaaggccguccacgccgacaugggcuacuggaucgagagcuccaagaaccagaccuggcagaucgagaaggccagccucaucgaggugaagacgugccuguggcccaagacccacacccugugguccaacggggugcucgagagccagaugcugaucccccgguccuacgcgggcccguucagccagcacaacuaccgccagggguacgccacccagaccgccggccccuggcaccuggggaagcucgagaucgacuucggcgagugccccggcacgaccgucaccauccaggaggacugcgaccaccgggggcccucccugcgcaccacgaccgccagcggcaagcuggugacccaguggugcugccgcuccugcaccaugccgccccuccgguuccugggggaggacggcugcugguacgggauggagauccgcccccugagcgagaaggaggagaacauggucaagagccaggucacggccggccagggcaccuccgagaccuucagcauggggcuccugugccugacccucuucguggaggagugccugcggcgccgggucacgcgcaagcacaugauccuggugguggucaucaccuucugcgcgaucauccucggcgggcugaccuggauggaccugcuccgggcccugaucaugcugggcgacaccauguccggccgcaucgggggccagauccaccucgccaucauggccguguucaagaugagccccggguacgugcugggcgucuuccugcggaagcucacgucccgcgagaccgcccugauggugaucgggauggcgaugaccaccguguucagcaucccgcacgagcugauggagcucaucgacggcaucucccugggccugauccuccugaagaucgucacgcacuucgacaacacccagguggggacccuggcccucagccugaccuucauccgguccacgacgccccuggugauggccuggcgcaccaucauggccgucuucuucguggugacccucaucccccugugccggacgagcugccugcagaagcagucccacugggucgagaucaccgcccucauccugggcgcgcaggcccugcccguguaccucaugacccugaugaagggggccagccgccgguccuggccgcugaacgagggcaucauggccguggggcucgucagccugcugggcuccgcgcuccugaagaacgacgugccccuggccggccccaugguggccgggggccuccugcuggccgccuacgucaugagcggguccagcgcggaccucucccuggagaaggccgccaacgugcagugggacgagauggccgacaucaccggcagcagccccaucaucgaggugaagcaggacgaggacggguccuucagcauccgcgacgucgaggagacgaacaugaucacccugcucgugaagcuggcccugaucaccguguccggccucuacccgcuggcgauccccgucaccauggcccugugguacguguggcaggucaagacgcagcggagcggcgcccucugggacguccccucccccgccgccacccagaaggcgacccugagcgaggggguguaccgcaucaugcagcggggccuguucgggaagacccaggugggcgucgggauccacauggagggcguguuccacaccauguggcacgugacgcgcggcuccgucaucugccacgagaccgggcggcucgagccgagcugggccgacgugcgcaacgacaugaucuccuacggcgggggcuggcgccugggcgacaagugggacaaggaggaggacgugcagguccuggccaucgagcccgggaagaaccccaagcacgugcagaccaagcccggccucuucaagacccugacgggggagaucggcgccgugacccuggacuucaagccggggaccagcggcucccccaucaucaacaagaagggcaaggucaucgggcucuacggcaacgggguggugaccaagagcggcgacuacgucuccgccaucacgcaggcggagcggaucggggagcccgacuacgagguggacgaggacaucuuccgcaagaagcggcugaccaucauggaccugcacccgggcgccggcaagaccaagcgcauccuccccagcaucgugcgggaggcccugaagcgccggcugcgcacccucauccuggcccccacgcgggucguggcggccgagauggaggaggcccugcgcgggcugcccauccgguaccagaccccggccgugaaguccgagcacaccggccgcgagaucgucgaccucaugugccacgccaccuucacgacccggcugcugagcuccacccgcgugcccaacuacaaccucaucgucauggacgaggcgcacuucaccgaccccugcagcguggccgcccggggguacaucuccacgcgcguggagaugggcgaggccgccgcgaucuucaugaccgccacgcccccggggagcaucgaccccuucccccagagcaacucccccaucgaggacaucgagcgggagaucccggagcgcagcuggaacaccggcuucgacuggaucacggacuaccagggcaagaccgucugguucgugcccuccaucaaggccgggaacgacaucgccaacugccugcgcaagagcggcaagcgcgugauccagcugucccgcaagaccuucgacaccgaguaccccaagacgaagcucaccgacugggacuucgucgugaccaccgacaucagcgagaugggggccaacuuccgggcgggccgcgugaucgacccccggcgcugccugaagccggucauccugacggacgggcccgagcgggugauccucgccggccccauccccgugaccccggccuccgccgcgcagcgccggggccgcaucgggcggaaccccgcccaggaggacgaccaguacgucuucagcggcgacccccugaagaacgacgaggaccacgcccacuggaccgaggccaagaugcugcucgacaacaucuacacccccgaggggaucaucccgacgcuguucggccccgagcgcgagaagacccaggccaucgacggcgaguuccggcugcgcggggagcagcggaagaccuucguggagcucaugcgccggggcgaccugcccguguggcuguccuacaaggucgcgagcgccgggaucuccuacaaggaccgcgaguggugcuucaccggcgagcggaacaaccagauccucgaggagaacauggagguggagaucuggacgcgcgagggggagaagaagaagcugcggcccaaguggcuggacgcccgcguguacgccgacccgauggcccucaaggacuucaaggaguucgcgagcggccggaaguccaucacccuggacauccugaccgagaucgccacccuccccaccuaccugagcuccaaggccaagcuggcccucgacaacaucgucaugcugcacacgaccgagaagggcgggcgcgccuaccagcacgcgcugaacgagcuccccgagagccuggagacccugaugcucguggcccugcugggcgccaugaccgccgggaucuuccucuucuucaugcagggcaaggggaucggcaagcuguccaugggccugaucgcgaucgccguggccagcgggcuccugugggucgccgagauccagccgcaguggaucgccgcguccaucauccuggaguucuuccucauggugcugcugauccccgagcccgagaagcagcgcacgccccaggacaaccagcucaucuacgugauccugaccauccugaccaucaucggccucaucgccgccaacgagauggggcugaucgagaagaccaagacggacuucggcuucuaccaggucaagaccgagaccaccauccuggacguggaccuccggccggccagcgccuggacgcuguacgcgguggccaccaccauccugacccccaugcuccgccacacgaucgagaacaccagcgccaaccugucccuggccgccaucgcgaaccaggccgccguccucauggggcugggcaagggcuggccccugcaccggauggaccucggggugccccugcuggccaugggcugcuacagccaggugaacccgaccacccucacggccucccuggucaugcugcucgugcacuacgcgaucaucgggcccggccugcaggccaaggccacccgcgaggcccagaagcggaccgcggccggcaucaugaagaaccccaccguggacgggaucacggucaucgaccuggagcccaucagcuacgacccgaaguucgagaagcagcucggccaggugaugcugcuggugcucugcgucgggcagcugcugcucaugcgcaccaccugggcccugugcgaggugcugacccucgccacgggccccgugaugacccugugggaggggaaccccggccgguucuggaacaccaccaucgccgucuccacggcgaacaucuuccgcggcagcuaccuggccggggccggccucgccuucucccugaucaagaacgcccagacgccccggcgcgggaccggcaccacgggggagacccugggcgagaaguggaagcggcagcucaacagccuggaccgcaaggaguucgaggaguacaagcgguccggcauccuggagguggaccgcaccgaggccaagagcgcccuccgggacggguccaagaucaaguacgccgugagccgcggcuccagcaagauccgguggaucgucgagcgcgggaugaucaagccgaagggcaaggugguggaccuggggugcggccggggcgggugguccuacuacauggccacccugaagaacgucaccgaggugaagggcuacacgaagggcggccccgggcacgaggagcccauccccauggccaccuacggcuggaaccucgugaagcugcacagcggcgucgacguguucuacaagccgaccgagcaggucgacacccugcucugcgacaucggggaguccagcuccaaccccacgaucgaggagggccgcacccugcgcguccugaagaugguggagcccuggcucagcagcaagcccgaguucugcaucaagguccugaacccguacaugcccaccgugaucgaggagcuggagaagcuccagcggcgccacgggggcucccuggugcggugcccccugagccgcaacuccacccacgagauguacugggucagcggcgcguccgggaacaucgugagcuccgugaacacgaucagcaagaugcugcucaaccgguucaccacccgccaccggaagcccaccuacgagaaggacgucgaccugggcgccgggacgcgcuccgugagcaccgagaccgagaagccggacaugaccaucaucggccggcgccugcagcggcuccgcgaggagcacaaggagacguggcacuacgaccaggagaaccccuaccggaccugggccuaccacggguccuacgaggcccccagcaccggcuccgcgagcuccauggugaacggcgucgugaagcugcugaccaagccgugggacgugauccccauggucacgcagcucgccaugaccgacaccacccccuucgggcagcagcgcguguucaaggagaagguggacacgcggacgccccagccgaagcccggcacccgcaugaucaugaccacgaccgccaacuggcugugggcccugcucgggaagaagaaguccccgcggcugugcacccgcgaggaguucaucuccaagguccggagcaacgccgcgaucggcgccguguuccaggaggagcagggguggaccuccgccagcgaggccgugaacgacagccgcuucugggagcuggucgacaaggagcgggcccuccaccaggagggcaagugcgaguccugcguguacaacaugaugggcaagcgcgagaagaagcugggggaguucggccgcgcgaaggggagccgggccaucugguacauguggcugggcgcccgcuuccucgaguucgaggcccugggguuccugaacgaggaccacugguucucccgggagaacagcugguccggcguggagggcgaggggcuccaccgccugggcuacauccuggaggacaucgacaagaaggacggggaccucaucuacgccgacgacacggcgggcugggacacccggaucaccgaggacgaccugcugaacgaggagcucaucaccgagcagauggcgccccaccacaagacgcuggccaaggccaucuucaagcugaccuaccagaacaaggucgugaaggugcuccgccccacccccaagggcgcggucauggacaucaucagccggaaggaccagcgcggguccggccagguggggaccuacggccugaacaccuucacgaacauggaggugcagcugauccggcagauggaggccgagggggucaucacccaggacgacaugcagaaccccaagggccucaaggagcgcguggagaaguggcugaaggagugcggcguggaccggcugaagcgcauggccaucagcggggacgacugcgucgugaagccccucgacgagcgguucuccaccagccugcuguuccucaacgacaugggcaaggugcgcaaggacaucccgcagugggagcccuccaagggguggaagaacuggcaggagguccccuucugcagccaccacuuccacaagaucuucaugaaggacggccggucccugguggugcccugccgcaaccaggacgagcugaucgggcgggcccgcaucagccagggcgccggcuggucccuccgggagaccgcgugccuggggaaggccuacgcccagauguggagccugauguacuuccaccgccgcgaccuccggcuggccuccauggccaucugcagcgcggucccgacggagugguuccccaccagccgcaccaccugguccauccacgcccaccaccaguggaugacgaccgaggacaugcugaagguguggaaccggguguggaucgaggacaaccccaacaugaccgacaagacccccguccacagcugggaggacaucccguaccucggcaagcgcgaggaccuguggugcgggucccugaucggccucagcucccgggccacgugggccaagaacauccacaccgccaucacccaggugcgcaaccugaucgggaaggaggaguacguggacuacaugcccgcgaugaagcgguacagcgcccccuucgaguccgagggcguccuguga

SEQ ID NO: 10493 - RNA, 9867 nt, Artificial Sequence
  derived and/or modified CDS sequence (opt1) from DENV-4__JQ915085__SS-prME
agcaccaugacccugcucugccugauccccaccgugauggccuuccaccugagcacccgcgacggcgagccgcucaugaucguggccaagcacgagcgggggcgcccccugcuguucaagaccaccgagggcaucaacaagugcacccucaucgcgauggaccugggggagaugugcgaggacaccgugaccuacaagugcccccugcucgugaacaccgagcccgaggacaucgacugcuggugcaaccugaccagcaccugggugauguacgggaccugcacccaguccggggagcggcgccgggagaagcgcagcguggcccugaccccgcacuccggcaugggccucgagacccgggccgagaccuggaugagcuccgagggggccuggaagcacgcccagcgcguggagagcuggauccugcggaaccccggcuucgcgcugcucgccggguucauggccuacaugaucggccagaccgggauccagcgcacggucuucuucgugcugaugaugcugguggcccccuccuacggcaugcggugcgucggcguggggaaccgcgacuucguggagggcgucagcgggggcgcguggguggaccucgugcuggagcacggcgggugcgucaccaccauggcccagggcaagcccacccuggacuucgagcucacgaagaccaccgccaaggagguggcccugcugcggaccuacugcaucgaggccuccaucagcaacaucacgaccgcgacccgcugcccgacccagggggagcccuaccucaaggaggagcaggaccagcaguacaucugccggcgcgacguggucgaccggggcugggggaacggcugcggccuguucgggaagggcgggguggugacgugcgccaaguuccugugcuccggcaagaucaccgggaaccucguccagaucgagaaccuggaguacaccgugguggucaccgugcacaacggcgacacgcacgccgucggcaacgacaccagcaaccacggggugaccgccaccaucacgccccgcucccccagcguggaggucaagcugccggacuacggcgagcucacccuggacugcgagccccgguccgggaucgacuucaacgagaugauccugaugaagaugaagaagaagaccuggcucgugcacaagcagugguuccuggaccugccccuccccuggaccgccggcgcggacaccagcgaggugcacuggaacuacaaggagcgcauggucacguucaaggugccgcacgccaagcggcaggacgugaccguccuggggucccaggagggcgccaugcacagcgcccuggccggcgcgaccgagguggacagcggggacggcaaccacauguucgccgggcaccucaagugcaaggugcgcauggagaagcugcgcaucaagggcauguccuacaccaugugcagcggcaaguucuccaucgacaaggagauggccgagacgcagcacgggaccaccgucgugaaggugaaguacgagggcgccggggcccccugcaagguccccaucgagauccgggacgugaacaaggagaagguggucggccgcaucaucagcuccacccccuucgcggagaacacgaacagcgugaccaacaucgagcuggagccgcccuucggggacuccuacaucgugaucggcgucggcgacagcgcccucacccugcacugguuccggaagggguccagcaucggcaagauguucgaguccaccuaccgcggggccaagcggauggccauccugggcgagacggcgugggacuucgggagcgugggcggccucuucaccucccuggggaaggccgugcaccaggucuucggcagcguguacaccaccauguucgggggcguguccuggaucauccgcauccugaucggguuccucguccuguggaucggcacgaacagccggaacaccuccauggccaugaccugcaucgccgugggcgggaucacccuguuccugggcuucacggugcaggccgacauggggugcgucgugagcuggaacggcaaggagcucaagugcggguccggcaucuucguggucgacaacgugcacaccuggaccgagcaguacaaguuccagcccgagagccccgcgcgccuggccagcgccauccugaacgcccacaaggacggcgugugcgggauccgguccaccacgcgccucgagaacgucauguggaagcagaucaccaacgagcugaacuacgugcugugggagggcgggcacgaccucaccguggucgccggcgacgugaagggcgugcugaccaaggggaagcgggcgcugacgccgcccgucaacgaccucaaguacagcuggaagaccuggggcaaggccaagaucuucacccccgaggcccgcaacuccaccuuccugaucgacgggcccgacacgagcgagugcccgaacgagcggcgcgccuggaacuucuucgagguggaggacuacggcuucgggauguucaccaccaacaucuggaugaaguuccgggagggcuccagcgaggugugcgaccaccgccugauguccgccgcgaucaaggaccagaaggccguccacgccgacaugggcuacuggaucgagagcuccaagaaccagaccuggcagaucgagaaggccagccucaucgaggugaagacgugccuguggcccaagacccacacccugugguccaacggggugcucgagagccagaugcugaucccccgguccuacgcgggcccguucagccagcacaacuaccgccagggguacgccacccagaccgccggccccuggcaccuggggaagcucgagaucgacuucggcgagugccccggcacgaccgucaccauccaggaggacugcgaccaccgggggcccucccugcgcaccacgaccgccagcggcaagcuggugacccaguggugcugccgcuccugcaccaugccgccccuccgguuccugggggaggacggcugcugguacgggauggagauccgcccccugagcgagaaggaggagaacauggucaagagccaggucacggccggccagggcaccuccgagaccuucagcauggggcuccugugccugacccucuucguggaggagugccugcggcgccgggucacgcgcaagcacaugauccuggugguggucaucaccuucugcgcgaucauccucggcgggcugaccuggguggaccugcuccgggcccugaucaugcugggcgacaccauguccggccgcaucgggggccagauccaccucgccaucauggccguguucaagaugagccccggguacguccugggcguguuccugcggaagcucacgucccgcgagaccgcccugauggugaucgggauggcgaugaccaccgucuucagcaucccgcgggaccugauggagcucaucgacggcaucucccugggccugauccuccugaagaucgugacgcacuucgacaacacccagguggggacccuggcccucagccugaccuucauccgcuccacgacgccccuggucauggccuggcggaccaucauggugguguucuucgucgugacccucaucccccugugccgcacgagcugccugcagaagcagucccacuggguggagaucaccgcccucauccugggcgcccaggcgcugcccgucuaccucaugacccugaugaagggggccagccggcgcuccuggccgcugaacgagggcaucauggccguggggcucgugagccugcugggcuccgcccuccugaagaacgacgucccccuggcgggccccaugguggccgggggccuccugcuggccgccuacgugaugagcggguccagcgccgaccucucccuggagaaggcggccaacguccagugggacgagauggccgacaucaccggcagcagccccaucaucgaggugaagcaggacgaggacggguccuucagcauccgggacguggaggagacgaacaugaucacccugcucgucaagcuggcccugaucaccguguccggccucuacccgcuggccauccccgugaccauggcgcugugguacaucuggcaggucaagacgcagcgcagcggcgcccucugggacgugcccucccccgccgccauccagaaggccacccugagcgaggggguguaccggaucaugcagcgcggccuguucgggaagacccaggucggcguggggauccacauggagggcguguuccacaccauguggcacgucacccggggcuccgugaucugccacgagacggggcgccucgagccgagcugggcggacgugcgcaacgacaugaucuccuacggcgggggcuggcggcugggcgacaagugggacaaggaggaggacguccaggugcuggccaucgagcccgggaagaaccccaagcacgugcagaccaagcccggccucuucaagacccugaccggggagaucggcgccgucacgcuggacuucaagccggggaccagcggcucccccaucaucaacaagaagggcaaggugaucgggcucuacggcaacgggguggucaccaagagcggcgacuacguguccgccaucacccaggccgagcgcaucggggagcccgacuacgagguggacgaggacaucuuccggaagaagcgccugacgaucauggaccugcacccgggcgcgggcaagaccaagcggauccuccccagcaucguccgcgaggcccugaagcggcgccugcggacccucauccuggcccccacccgcgugguggccgcggagauggaggaggcccugcgggggcugcccauccgcuaccagacgccggccgucaaguccgagcacaccggccgggagaucguggaccucaugugccacgccaccuucaccacgcgccugcugagcuccacccggguccccaacuacaaccucaucgugauggacgaggcccacuucaccgaccccugcagcguggcggcccgcggguacaucuccacccgggucgagaugggcgaggccgccgccaucuucaugacggcgacgcccccggggagcaucgaccccuucccccagagcaacucccccaucgaggacaucgagcgcgagaucccggagcggagcuggaacaccggcuucgacuggaucaccgacuaccagggcaagacggugugguucgugcccuccaucaaggccgggaacgacaucgccaacugccugcgcaagagcggcaagaaggucauccagcugucccgcaagaccuucgacaccgaguaccccaagaccaagcucacggacugggacuucguggugaccaccgacaucagcgagaugggggccaacuuccgggccggccgcgucaucgacccccggcgcugccugaagccggugauccugaccgacgggcccgagcgggugauccucgcgggccccauccccgucacgccggccuccgccgcccagcgccggggccgcaucgggcggaaccccgcgcaggaggacgaccaguacguguucagcggcgacccccugaagaacgacgaggaccacgcccacuggaccgaggccaagaugcugcucgacaacaucuacacccccgaggggaucaucccgacccuguucggccccgagcgcgagaagacgcaggccaucgacggcgaguuccggcugcgcggggagcagcggaagaccuucguggagcucaugcgccggggcgaccugcccgucuggcuguccuacaagguggccagcgcggggaucuccuacaaggaccgcgaguggugcuucaccggcgagcggaacaaccagauccucgaggagaacauggagguggagaucuggacccgcgagggggagaagaagaagcugcggcccaaguggcuggacgcccgcgucuacgccgacccgauggcccucaaggacuucaaggaguucgccagcggccggaaguccaucacgcuggacauccugaccgagaucgcgacccuccccaccuaccugagcuccaaggccaagcuggcccucgacaacaucgugaugcugcacaccgccgagaagggcgggcgcgccuaccagcacgcgcugaacgagcuccccgagagccuggagacgcugaugcucguggcccugcugggcgccaugaccgccgggaucuuccucuucuucaugcagggcaaggggaucggcaagcuguccaugggccugaucgcgaucgccgucgccagcgggcuccuguggguggccgagauccagccgcaguggaucgccgcguccaucauccuggaguucuuccucauggugcugcugauccccgagcccgagaagcagcgcacgccccaggacaaccagcucaucuacgucauccugaccauccugacgaucaucggccucaucgccgccaacgagauggggcugaucgagaagaccaagaccgacuucggcuucuaccaggugaagaccgagacgaccauccuggacguggaccuccggccggccagcgccuggacccuguacgcggucgccaccacgauccugacccccaugcuccgccacaccaucgagaacaccagcgccaaccugucccuggccgccaucgcgaaccaggccgccgugcucauggggcugggcaagggcuggccccugcaccggauggaccucggggugccccugcuggccaugggcugcuacagccaggucaacccgacgacccucaccgccucccuggugaugcugcucgugcacuacgcgaucaucgggcccggccugcaggccaaggccacccgcgaggcccagaagcggacggcggccggcaucaugaagaaccccaccgucgacgggaucaccgugaucgaccuggagcccaucagcuacgacccgaaguucgagaagcagcucggccaggugaugcugcugguccucugcguggggcagcugcugcucaugcgcaccacgugggcccugugcgaggugcugacccucgccaccggccccaucaugacccugugggaggggaaccccggccgguucuggaacacgaccaucgccgucuccaccgcgaacaucuuccgcggcagcuaccuggccggggccggccucgccuucucccugaucaagaacgcccagacgccccggcgcgggacgggcaccaccggggagacccugggcgagaaguggaagcggcagcucaacagccuggaccgcaaggaguucgaggaguacaagcgguccggcauccuggagguggaccgcacggaggccaagagcgcccuccgggacggguccaagaucaagcacgccgugagccgcggcuccagcaagauccgguggaucgucgagcgcgggaugaucaagccgaagggcaaggugguggaccuggggugcggccggggcgggugguccuacuacauggccacccugaagaacgucaccgaggugaagggcuacaccaagggcggccccgggcacgaggagcccauccccauggccaccuacggcuggaaccucgugaagcugcacagcggcgucgacguguucuacaagccgacggagcaggucgacacccugcucugcgacaucggggaguccagcuccaaccccaccaucgaggagggccgcacccugcgcguccugaagaugguggagcccuggcucagcagcaagcccgaguucugcaucaagguccugaacccguacaugcccacggugaucgaggagcuggagaagcuccagcggcgccacgggggcucccuggugcggugcccccugagccgcaacuccacccacgagauguacugggucagcggcgcguccgggaacaucgugagcuccgugaacaccaucagcaagaugcugcucaaccgguucaccacgcgccaccggaagcccaccuacgagaaggacgucgaccugggcgccgggacccgcuccgugagcaccgagacggagaagccggacaugaccaucaucggccggcgccugcagcggcuccgcgaggagcacaaggagaccuggcacuacgaccaggagaaccccuaccggaccugggccuaccacggguccuacgaggcccccagcacgggcuccgcgagcuccauggugaacggcgucgugaagcugcugaccaagccgugggacgugauccccauggucacccagcucgccaugaccgacacgacccccuucgggcagcagcgcguguucaaggagaagguggacacccggacgccccagccgaagcccggcacgcgcaugaucaugaccaccaccgccaacuggcugugggcccugcucgggaagaagaaguccccgcggcugugcacgcgcgaggaguucaucuccaagguccggagcaacgccgcgaucggcgccguguuccaggaggagcagggguggaccuccgccagcgaggccgugaacgacagccgcuucugggagcuggucgacaaggagcgggcccuccaccaggagggcaagugcgaguccugcguguacaacaugaugggcaagcgcgagaagaagcugggggaguucggccgcgcgaaggggagccgggccaucugguacauguggcugggcgcccgcuuccucgaguucgaggcccugggguuccugaacgaggaccacugguucucccgggagaacagcugguccggcguggagggcgaggggcuccaccgccugggcuacauccuggaggacaucgacaagaaggacggggaccucaucuacgccgacgacaccgcgggcugggacacccggaucacggaggacgaccugcugaacgaggagcucaucaccgagcagauggcgccccaccacaagacccuggccaaggccaucuucaagcugaccuaccagaacaaggucgugaaggugcuccgccccacgcccaagggcgcggucauggacaucaucagccggaaggaccagcgcggguccggccagguggggaccuacggccugaacaccuucaccaacauggaggugcagcugauccggcagauggaggccgagggggucaucacccaggacgacaugcagaaccccaagggccucaaggagcgcguggagaaguggcugaaggagugcggcguggaccggcugaagcgcauggccaucagcggggacgacugcgucgugaagccccucgacgagcgguucuccacgagccugcuguuccucaacgacaugggcaaggugcgcaaggacaucccgcagugggagcccuccaagggguggaagaacuggcaggagguccccuucugcagccaccacuuccacaagaucuucaugaaggacggccggucccugguggugcccugccgcaaccaggacgagcugaucgggcgggcccgcaucagccagggcgccggcuggucccuccgggagaccgcgugccuggggaaggccuacgcccagauguggagccugauguacuuccaccgccgcgaccuccggcuggccuccauggccaucugcagcgcggucccgaccgagugguuccccaccagccgcacgaccugguccauccacgcccaccaccaguggaugaccaccgaggacaugcugaagguguggaaccggguguggaucgaggacaaccccaacaugacggacaagacccccguccacagcugggaggacaucccguaccucggcaagcgcgaggaccuguggugcgggucccugaucggccucagcucccgggccaccugggccaagaacauccacaccgccaucacccaggugcgcaaccugaucgggaaggaggaguacguggacuacaugcccgcgaugaagcgguacagcgcccccuucgaguccgagggcguccuguga

SEQ ID NO: 10494 - RNA, 9867 nt, Artificial Sequence
  derived and/or modified CDS sequence (opt1) from DENV-4__JQ915088__SS-prME
agcaccaugacccugcucugccugauccccaccgugauggccuuccaccuguccacccgcgacggcgagccgcucaugaucguggccaagcacgagcgggggcgcccccugcuguucaagaccaccgagggcaucaacaagugcacccucaucgcgauggaccugggggagaugugcgaggacaccgugaccuacaagugcccccugcucgugaacaccgagcccgaggacaucgacugcuggugcaaccugacgagcaccugggucauguacgggaccugcacccaguccggggagcggcgccgggagaagcgcagcguggcccugacgccgcacuccggcaugggccucgagacccgggccgagaccuggaugagcuccgagggggccuggaagcacgcccagcgcguggagagcuggauccugcggaaccccggcuucgcgcugcucgccggguucauggccuacaugaucggccagaccgggauccagcgcaucgucuucuucgugcugaugaugcugguggcccccuccuacggcaugcggugcgucggcguggggaaccgcgacuucguggagggcgucagcgggggcgcguggguggaccucgugcuggagcacggcgggugcgucacgaccauggcccagggcaagcccacccuggacuucgagcucaccaagacgaccgccaaggagguggcccugcugcggaccuacugcaucgaggccuccaucagcaacaucaccacggcgacccgcugcccgacccagggggagcccuaccucaaggaggagcaggaccagcaguacaucugccggcgcgacguggucgaccggggcugggggaacggcugcggccuguucgggaagggcgggguggugaccugcgccaaguuccugugcuccggcaagaucacggggaaccucguccagaucgagaaccuggaguacaccgugguggucaccgugcacaacggcgacacccacgccgucggcaacgacacgagcaaccacggggugaccgccaccaucacgccccggucccccagcguggaggucaagcugccggacuacggcgagcucacgcuggacugcgagccccgguccgggaucgacuucaacgagaugauccugaugaagaugaagaagaagaccuggcucgugcacaagcagugguuccuggaccugccccuccccuggaccgccggcgcggacaccagcgaggugcacuggaacuacaaggagcgcauggucaccuucaaggugccgcacgccaagcggcaggacgugacgguccuggggucccaggagggcgccaugcacagcgcccuggccggcgcgaccgagguggacagcggggacggcaaccacauguucgccgggcaccucaagugcaaggugcgcauggagaagcugcgcaucaagggcauguccuacaccaugugcagcggcaaguucuccaucgacaaggagauggccgagacccagcacgggacgaccgucgugaaggugaaguacgagggcgccggggcccccugcaagauccccaucgagauccgggacgucaacaaggagaagguggugggccgcaucaucagcuccacccccuucgcggagaacaccaacagcgucaucaacaucgagcuggagccgcccuucggggacuccuacaucgugaucggcgugggcgacagcgcccucacgcugcacugguuccggaagggguccagcaucggcaagauguucgaguccaccuaccgcggggccaagcggauggccauccugggcgagaccgcgugggacuucgggagcgucggcggccucuucaccucccuggggaaggccgugcaccagguguucggcagcgucuacacgaccauguucgggggcguguccuggaugauccgcauccugaucggguuccucgugcuguggaucggcaccaacagccggaacaccuccauggccaugacgugcaucgccgucggcgggaucacccuguuccugggcuucaccgugcaggccgacauggggugcguggucagcuggaacggcaaggagcucaagugcggguccggcaucuucgugguggacaacguccacaccuggacggagcaguacaaguuccagcccgagagccccgcgcgccuggccagcgccauccugaacgcccacaaggacggcgugugcgggauccgguccaccacccgccucgagaacgugauguggaagcagaucaccaacgagcugaacuacguccugugggagggcgggcacgaccucacggugguggccggcgacgucaagggcgugcugaccaaggggaagcgggcgcugaccccgcccgugaacgaccucaaguacagcuggaagaccuggggcaaggccaagaucuccacgcccgaggcccgcaacagcaccuuccugaucgacgggcccgacaccuccgagugcccgaacgagcggcgcgccuggaacuucuucgaggucgaggacuacggcuucgggauguucaccacgaacaucuggaugaaguuccgggagggcagcuccgaggugugcgaccaccgccugaugagcgccgcgaucaaggaccagaaggccgugcacgccgacaugggcuacuggaucgaguccagcaagaaccagaccuggcagaucgagaaggccucccucaucgaggucaagaccugccuguggcccaagacccacacgcuguggagcaacggggugcucgagucccagaugcugaucccccggagcuacgcgggcccguucucccagcacaacuaccgccagggguacgccacccagaccgccggccccuggcaccuggggaagcucgagaucgacuucggcgagugccccggcaccaccgugaagauccaggaggacugcgaccaccgggggcccagccugcgcacgaccaccgccuccggcaagcuggucacccaguggugcugccgcagcugcacgaugccgccccuccgguuccugggggaggacggcugcugguacgggauggagauccgcccccugagcgagaaggaggagaacauggugaagucccaggugaccgccggccagggcaccagcgagaccuucuccauggggcuccugugccugacccuguucgucgaggagugccugcggcgccgggugacccgcaagcacaugauccuggucguggugaucaccuucugcgcgaucauccucggcgggcugaccuggauggaccugcuccgggcccugaucaugcugggcgacacgaugagcggccgcaucgggggccagauccaccucgccaucaugaccgucuucaagaugucccccggguacgugcugggcguguuccugcggaagcucaccagccgcgagaccgcccugauggucaucgggauggccaugacgaccguguucuccaucccgcacgaccugauggagcucaucgacggcaucagccugggccugauccuccugaagaucgugacccacuucgacaacacccaggucgggacgcuggcgcucucccugaccuucaugcggagcaccacgccccuggugauggccuggcgcacgaucauggccguguucuucgucaucacccucaucccccugugccggaccuccugccugcagaagcagagccacuggguggagaucaccgcccucauccugggcgcccaggcgcugcccguguaccucaugacgcugaugaagggggccucccgccggagcuggccgcugaacgagggcaucauggccgucgggcucgugucccugcugggcagcgcccuccugaagaacgacgugccccuggcgggccccauggucgccgggggccuccugcuggccgccuacgugauguccgggagcuccgccgaccucagccuggagaaggcggccaacgugcagugggacgagauggccgacaucaccggcagcucccccaucaucgaggucaagcaggacgaggacgggagcuucuccauccgcgacguggaggagaccaacaugaucacccugcucgugaagcuggcccugaucacggucagcggccucuacccgcuggccauccccgugaccauggcgcugugguacaucuggcaggucaagacccagcgguccggcgcccucugggacguccccagccccgccgccacccagaaggccacgcuguccgaggggguguaccgcaucaugcagcggggccuguucgggaagacccaggugggcgucgggauccacauggagggcguguuccacaccauguggcacgugacccgcggcagcgucaucugccacgagaccgggcggcucgagccguccugggcggacgugcgcaacgacaugaucagcuacggcgggggcuggcgccugggcgacaagugggacaaggaggaggacgugcagguccuggccaucgagcccgggaagaacccccggcacgugcagacgaagcccggccucuucaagacccugaccggggagaucggcgccgugacccuggacuucaagccggggacguccggcagccccaucaucaacaagaagggcaaggucaucgggcucuacggcaacgggguggugaccaaguccggcgacuacgucagcgccaucacccaggccgagcgcaucggggagcccgacuacgagguggacgaggacaucuuccggaagaagcgccugaccaucauggaccugcacccgggcgcgggcaagacgaagcggauccuccccuccaucgugcgcgaggcccugaagcggcgccugcggacccucauccuggcccccacccgcgucguggccgcggagauggaggaggcccugcgggggcugcccauccgcuaccagaccccggccgugaaguccgagcacacgggccgggagaucgucgaccucaugugccacgccaccuucaccacccgccugcuguccagcacgcgggugcccaacuacaaccucaucgugauggacgaggcccacuucaccgaccccugcuccgucgcggcccgcggguacaucagcacccggguggagaugggcgaggccgccgccaucuucaugaccgcgacgcccccggggagcaucgaccccuucccccaguccaacagccccaucgaggacaucgagcgcgagaucccggagcgguccuggaacaccggcuucgacuggaucaccgacuaccagggcaagaccgucugguucgugcccagcaucaaggccgggaacgacaucgccaacugccugcgcaaguccggcaagcgcgugauccagcugagccggaagacguucgacaccgaguaccccaagaccaagcucaccgacugggacuucgucgugacgaccgacaucuccgagaugggggccaacuuccgcgccggccgggugaucgacccccgccggugccugaagccggucauccugaccgacgggcccgagcgcgugauccucgcgggccccauccccgugaccccggccagcgccgcccagcggcgcggccggaucgggcgcaaccccgcgcaggaggacgaccaguacgucuucuccggcgacccccugaagaacgacgaggaccacgcccacuggacggaggccaagaugcugcucgacaacaucuacacccccgaggggaucaucccgacccuguucggccccgagcgggagaagacccaggccaucgacggcgaguuccgccugcgcggggagcagcgcaagacguucguggagcucaugcggcgcggcgaccugcccguguggcugagcuacaaggucgccuccgcggggaucagcuacaaggaccgggaguggugcuucaccggcgagcgcaacaaccagauccucgaggagaacauggagguggagaucuggacccgggagggggagaagaagaagcugcgccccaaguggcuggacgcccggguguacgccgacccgauggcccucaaggacuucaaggaguucgccuccggccgcaagagcaccacgcuggacauccugaccgagaucgcgacccuccccaccuaccuguccagcaaggccaagcuggcccucgacaacaucgucaugcugcacaccacggagaagggcgggcgcgccuaccagcacgcccugaacgagcuccccgagucccuggagacccugaugcucguggcgcugcugggcgccaugaccgccgggaucuuccucuucuucaugcagggcaaggggaucggcaagcugagcaugggccugaucgccauggcgguggccuccgggcuccugugggucgccgagauccagccgcaguggaucgccgccagcaucauccuggaguucuuccucauggugcugcugauccccgagcccgagaagcagcggacgccccaggacaaccagcucaucuacgugauccugacgauccugaccaucaucggccucaucgcggccaacgagauggggcugaucgagaagaccaagaccgacuucggcuucuaccaggucaagacggagaccaccauccuggacguggaccuccgcccggccagcgccuggacccuguacgccguggcgacgaccauccugacccccaugcuccggcacaccaucgagaacacguccgccaaccugagccuggccgccaucgccaaccaggcggccguccucauggggcugggcaagggcuggccccugcaccgcauggaccucggggugccccugcuggccaugggcugcuacucccaggugaacccgaccacccucaccgccagccuggucaugcugcucauccacuacgccaucaucgggcccggccugcaggcgaaggccacgcgggaggcccagaagcgcaccgccgcgggcaucaugaagaaccccaccguggacgggaucaccgugaucgaccuggagcccaucuccuacgacccgaaguucgagaagcagcucggccaggucaugcugcuggugcucugcguggggcagcugcugcucaugcggacgaccugggcccugugcgagguccugacccucgccaccggccccaucaugacgcugugggaggggaaccccggccgcuucuggaacaccaccaucgccgugagcaccgccaacaucuuccggggcuccuaccuggcgggggccggccucgccuucagccugaucaagaacgcccagacgccccgccgggggaccggcaccaccggggagacgcugggcgagaaguggaagcgccagcucaacucccuggaccggaaggaguucgaggaguacaagcgcagcggcauccuggagguggaccggaccgaggccaaguccgcgcuccgcgacgggagcaagaucaagcacgccgucucccggggcagcuccaagauccgcuggaucguggagcgggggaugaucaagccgaagggcaagguggucgaccuggggugcggccgcggcggguggagcuacuacauggccacccugaagaacgugaccgaggugaagggcuacaccaagggcggccccgggcacgaggagcccauccccauggccacguacggcuggaaccucgucaagcugcacuccggcguggacguguucuacaagccgaccgagcaggucgacacccugcucugcgacaucggggagagcuccagcaaccccaccaucgaggagggccgcacgcugcggauccugaagaugguggagcccuggcucagcuccaagcccgaguucugcaucaaggugcugaacccguacaugcccaccgucaucgaggagcuggagaagcuccagcgccggcacgggggcagccuggugcgcugcccccugucccggaacagcacccacgagauguacuggguguccggcgccagcgggaacaucgucuccagcgugaacaccaucuccaagaugcugcucaaccgcuucacgacccggcaccgcaagcccaccuacgagaaggacgucgaccugggcgcggggacccggagcguguccacggagaccgagaagccggacaugaccaucaucggccgccggcugcagcgccuccaggaggagcacaaggagaccuggcacuacgaccaggagaaccccuaccggacgugggccuaccacgggagcuacgaggcccccuccaccggcagcgccuccagcauggugaacggcgucgugaagcugcugaccaagccgugggacgugauccccauggucacccagcucgcgaugacggacaccacccccuucgggcagcagcgcguguucaaggagaagguggacacccggacgccccagccgaagcugggcacccgcaugaucaugaccaccacggccaacuggcugugggcccuccuggggaagaagaaguccccgcggcugugcacccgcgaggaguucaucagcaagguccggagcaacgccgccaucggcgcgguguuccaggaggagcagggguggaccagcgccagcgaggccgugaacgacucccgcuucugggagcucgucgacaaggagcgggcccugcaccaggagggcaagugcgagagcugcguguacaacaugaugggcaagcgcgagaagaagcugggggaguucggccgcgccaaggggucccgggcgaucugguacauguggcucggcgcccgcuuccuggaguucgaggcccugggguuccucaacgaggaccacugguucagccgggagaacuccuggagcggcguggagggcgaggggcugcaccgccugggcuacauccucgaggacaucgacaagaaggacggggaccugaucuacgccgacgacaccgccggcugggacacgcggaucaccgaggacgaccugcucaacgaggagcugaucaccgagcagauggcgccccaccacaagacccuggccaaggccaucuucaagcucacguaccagaacaaggucgugaaggugcugcgccccacccccaagggcgccgucauggacaucaucucccggaaggaccagcgcgggagcggccagguggggaccuacggccugaacaccuucaccaacauggaggugcagcucauccggcagauggaggcggagggggucaucacgcaggacgacaugcagaaccccaagggccugaaggagcgcguggagaaguggcugaaggagugcggcguggaccggcucaagcgcauggccaucuccggggacgacugcgucgugaagccccuggacgagcgguucagcaccucccuccucuuccugaacgacaugggcaaggugcgcaaggacgucccccagugggagccgagcaagggguggaagaacuggcaggaggugcccuucugcucccaccacuuccacaagaucuucaugaaggacggccggagccuggugguccccugccgcaaccaggacgagcucaucgggcgggcccgcaucucccagggcgccggcuggagccugcgggagaccgccugccuggggaaggcguacgcccagauguggucccucauguacuuccaccgccgcgaccugcggcuggccagcauggccaucugcagcgccgugcccaccgagugguucccgacgucccgcaccaccuggagcauccacgcgcagcaccaguggaugaccacggaggacaugcucaagguguggaaccgggucuggaucgaggacaaccccaacaugaccgacaagacccccgugcacuccugggaggacauccccuaccugggcaagcgcgaggaccuguggugcgggagccucaucggccuguccagccgggccaccugggccaagaacauccacacggccaucacccaggugcgcaaccugaucgggaaggaggaguacgucgacuacaugccggugaugaagcgguacuccagccccuccgagagcgagggcgugcucuga

SEQ ID NO: 10495 - RNA, 9867 nt, Artificial Sequence
  derived and/or modified CDS sequence (opt1) from DENV-4__JQ915086__SS-prME
agcaccaugacccugcucugccugauccccaccgugauggccuuccaccugagcacccgcgacggcgagccgcucaugaucguggccaagcacgagcgggggcgcccccugcuguucaagaccaccgagggcaucaacaagugcacccucaucgcgauggaccugggggagaugugcgaggacaccgugaccuacaagugcccccugcucgugaacaccgagcccgaggacaucgacugcuggugcaaccugacgagcaccugggugauguacgggaccugcacccaguccggggagcggcgccgggagaagcgcagcguggcccugacgccgcacuccggcaugggccucgagacccgggccgagaccuggaugagcuccgagggggccuggaagcacgcccagcgcguggagagcuggauccugcggaaccccggcuucgcgcugcucgccggguucauggccuacaugaucggccagaccgggauccagcgcacggucuucuucgugcugaugaugcugguggcccccuccuacggcaugcggugcgucggcguggggaaccgcgacuucguggagggcgucagcgggggcgcguggguggaccucgugcuggagcacggcgggugcgucaccaccauggcccagggcaagcccacccuggacuucgagcucacgaagaccaccgccaaggagguggcccugcugcggaccuacugcaucgaggccuccaucagcaacaucacgaccgcgacccgcugcccgacccagggggagcccuaccucaaggaggagcaggaccagcaguacaucugccggcgcgacguggucgaccggggcugggggaacggcugcggccuguucgggaagggcgggguggugacgugcgccaaguuccugugcuccggcaagaucaccgggaaccucguccagaucgagaaccuggaguacaccgugguggucaccgugcacaacggcgacacgcacgccgucggcaacgacaccagcaaccacggggugaccgccaccaucacgccccgcucccccagcguggaggucaagcugccggacuacggcgagcucacccuggacugcgagccccgguccgggaucgacuucaacgagaugauccugaugaagaugaagaagaagaccuggcucgugcacaagcagugguuccuggaccugccccuccccuggaccgccggcgcggacaccagcgaggugcacuggaacuacaaggagcgcauggucacguucaaggugccgcacgccaagcggcaggacgugaccguccuggggucccaggagggcgccaugcacagcgcccuggccggcgcgaccgagguggacagcggggacggcaaccacauguucgccgggcaccucaagugcaaggugcgcauggagaagcugcgcaucaagggcauguccuacaccaugugcagcggcaaguucuccaucgacaaggagauggccgagacgcagcacgggaccaccgucgugaaggugaaguacgagggcgccggggcccccugcaagauccccaucgagauccgggacgucaacaaggagaagguggugggccgcaucaucagcuccacccccuucgcggagaacacgaacagcgucaucaacaucgagcuggagccgcccuucggggacuccuacaucgugaucggcgugggcgacagcgcccucacccugcacugguuccggaagggguccagcaucggcaagauguucgaguccaccuaccgcggggccaagcggauggccauccugggcgagaccgcgugggacuucgggagcgucggcggccucuucacgucccuggggaaggccgugcaccagguguucggcagcgucuacaccaccauguucgggggcguguccuggaugauccgcauccugaucggguuccucgugcuguggaucggcaccaacagccggaacacguccauggccaugaccugcaucgccgucggcgggaucacccuguuccugggcuucaccgugcaggccgacauggggugcguggucagcuggaacggcaaggagcucaagugcggguccggcaucuucgugguggacaacguccacacguggaccgagcaguacaaguuccagcccgagagccccgcgcgccuggccagcgccauccugaacgcccacaaggacggcgugugcgggauccgguccaccacccgccucgagaacgugauguggaagcagaucacgaacgagcugaacuacguccugugggagggcgggcacgaccucaccgugguggccggcgacgucaagggcgugcugaccaaggggaagcgggugcugaccccgcccgucaacgaccucaaguacagcuggaagacguggggcaaggcgaagaucuucacccccgaggcccgcaacuccaccuuccugaucgacgggcccgacaccagcgagugcccgaacgagcggcgcgccuggaacuucuucgagguggaggacuacggcuucgggauguucacgaccaacaucuggaugaaguuccgggagggcuccagcgaggugugcgaccaccgccugauguccgccgccaucaaggaccagaaggcgguccacgccgacaugggcuacuggaucgagagcuccaagaaccagaccuggcagaucgagaaggccagccucaucgaggugaagaccugccuguggcccaagacgcacacccugugguccaacggggugcucgagagccagaugcugaucccccgguccuacgccggcccguucagccagcacaacuaccgccagggguacgcgacccagaccgccggccccuggcaccuggggaagcucgagaucgacuucggcgagugccccggcaccacggucaagauccaggaggacugcgaccaccgggggcccucccugcgcaccaccaccgccagcggcaagcuggugacgcaguggugcugccgcuccugcaccaugccgccccuccgguuccugggggaggacggcugcugguacgggauggagauccgcccccugagcgagaaggaggagaacauggucaagagccaggucaccgccggccagggcaccuccgagacguucagcauggggcuccugugccugacccucuucguggaggagugccugcggcgccgggucacccgcaagcacaugauccuggugguggucaucaccuucugcgccaucauccucggcgggcugacguggauggaccugcuccgggcgcugaucaugcugggcgacaccauguccggccgcaucgggggccagauccaccucgccaucaugaccguguucaagaugagccccggguacgugcugggcgucuuccugcggaagcucaccucccgcgagacggcccugauggugaucgggauggccaugaccaccguguucagcaucccgcacgaccugauggagcucaucgacggcaucucccugggccugauccuccugaagaucgucacccacuucgacaacacccagguggggacccuggcccucagccugaccuucauccgguccaccacgccccuggugauggcguggcgcaccaucauggccgucuucuucgugaucacccucaucccccugugccggaccagcugccugcagaagcagucccacuggguggagaucacggcccucauccugggcgcccaggcccugcccgucuaccucaugacccugaugaagggggcgagccgccgguccuggccgcugaacgagggcaucauggccguggggcucgugagccugcugggcuccgcccuccugaagaacgacgucccccuggccggccccaugguggccgggggccuccugcuggccgccuacgugaugagcggguccagcgccgaccucucccuggagaaggccgcgaacguccagugggacgagauggccgacaucaccggcagcagccccaucaucgaggugaagcaggacgaggacggguccuucagcauccgcgacguggaggagaccaacaugaucacgcugcucgucaagcuggcccugaucaccguguccggccucuacccgcuggccauccccgugaccauggcccugugguacaucuggcaggucaagacccagcggagcggcgcgcucugggacgugcccucccccgccgccacgcagaaggccacccugagcgaggggguguaccgcaucaugcagcggggccuguucgggaagacccaggucggcguggggauccacauggagggcguguuccacaccauguggcacgucacccgcggcuccgugaucugccacgagacggggcggcucgagccgagcugggccgacgugcgcaacgacaugaucuccuacggcgggggcuggcgccugggcgacaagugggacaaggaggaggacguccaggugcuggcgaucgagcccgggaagaacccccggcacgugcagaccaagcccggccucuucaagacccugaccggggagaucggcgccgucacgcuggacuucaagccggggaccagcggcucccccaucaucaacaagaagggcaaggugaucgggcucuacggcaacgggguggucaccaagagcggcgacuacguguccgccaucacccaggccgagcgcaucggggagcccgacuacgagguggacgaggacaucuuccggaagaagcgccugacgaucauggaccugcacccgggcgccggcaagaccaagcggauccuccccagcaucguccgcgaggcgcugaagcggcgccugcggacccucauccuggcccccacccgcgugguggccgccgagauggaggaggcgcugcgggggcugcccauccgcuaccagacgccggccgucaaguccgagcacaccggccgggagaucguggaccucaugugccacgccaccuucaccacgcgccugcugagcuccacccgggugcccaacuacaaccucaucgucauggacgaggcccacuucaccgaccccugcagcguggccgcgcgcggguacaucuccacccgggucgagaugggcgaggccgccgccaucuucaugacggccacgcccccggggagcaucgaccccuucccccagagcaacucccccaucgaggacaucgagcgcgagaucccggagcggagcuggaacaccggcuucgacuggaucaccgacuaccagggcaagacggugugguucgugcccuccaucaaggcggggaacgacaucgccaacugccugcgcaagagcggcaagcgcgucauccagcugucccggaagaccuucgacaccgaguaccccaagaccaagcucacggacugggacuucguggugaccaccgacaucagcgagaugggggccaacuuccgcgccggccgggucaucgacccccgccggugccugaagccggugauccugaccgacgggcccgagcgcgugauccucgccggccccauccccgucacgccggcguccgccgcccagcggcgcggccggaucgggcgcaaccccgcccaggaggacgaccaguacguguucagcggcgacccccugaagaacgacgaggaccacgcgcacuggaccgaggccaagaugcugcucgacaacaucuacacccccgaggggaucaucccgacccuguucggccccgagcgggagaagacgcaggccaucgacggcgaguuccgccugcgcggggagcagcgcaagaccuucguggagcucaugcggcgcggcgaccugcccgucuggcuguccuacaagguggccagcgccgggaucuccuacaaggaccgggaguggugcuucaccggcgagcgcaacaaccagauccucgaggagaacauggagguggagaucuggacccgggagggggagaagaagaagcugcgccccaaguggcuggacgcgcgggucuacgccgacccgauggcccucaaggacuucaaggaguucgccagcggccgcaaguccacgacccuggacauccugaccgagaucgccacccuccccaccuaccugagcuccaaggcgaagcuggcccucgacaacaucgugaugcugcacacgaccgagaagggcgggcgcgccuaccagcacgcccugaacgagcuccccgagagccuggagacccugaugcucguggcccugcugggcgcgaugaccgccgggaucuuccucuucuucaugcagggcaaggggaucggcaagcuguccaugggccugaucgccaucgccgucgcgagcgggcuccuguggguggccgagauccagccgcaguggaucgccgccuccaucauccuggaguucuuccucauggugcugcugauccccgagcccgagaagcagcggacgccccaggacaaccagcucaucuacgucauccugaccauccugaccaucaucggccucaucgccgcgaacgagauggggcugaucgagaagaccaagacggacuucggcuucuaccaggugaagaccgagaccaccauccuggacguggaccuccgcccggccagcgccuggacgcuguacgccgucgccaccaccauccugacccccaugcuccggcacacgaucgagaacaccagcgcgaaccugucccuggccgccaucgccaaccaggccgcggugcucauggggcugggcaagggcuggccccugcaccgcauggaccucggggugccccugcuggccaugggcugcuacagccaggucaacccgaccacccucacggccucccuggugaugcugcucauccacuacgccaucaucgggcccggccugcaggccaaggcgacccgggaggcccagaagcgcaccgccgccggcaucaugaagaaccccaccguggacgggaucacggucaucgaccuggagcccaucagcuacgacccgaaguucgagaagcagcucggccaggugaugcugcuggugcucugcgucgggcagcugcugcucaugcggaccaccugggcgcugugcgaggugcugacccucgccacgggccccaucaugacccugugggaggggaaccccggccgcuucuggaacaccaccaucgccguguccacggccaacaucuuccggggcagcuaccuggccggggcgggccucgccuucucccugaucaagaacgcccagacgccccggcgggggaccggcaccacgggggagacccugggcgagaaguggaagcgccagcucaacagccuggaccggaaggaguucgaggaguacaagcgcuccggcauccuggaggucgaccggaccgaggccaagagcgcccuccgcgacggguccaagaucaagcacgcggugagccggggcuccagcaagauccgcuggaucguggagcgggggaugaucaagccgaagggcaaggucguggaccuggggugcggccgcggcgggugguccuacuacauggccacccugaagaacgugaccgaggucaagggcuacacgaagggcggccccgggcacgaggagcccauccccauggccaccuacggcuggaaccucgugaagcugcacagcggcguggacgucuucuacaagccgaccgagcaggucgacacccugcucugcgacaucggggaguccagcuccaaccccacgaucgaggagggccgcacccugcggauccugaagaugguggagcccuggcucagcagcaagcccgaguucugcaucaagguccugaacccguacaugcccaccgugaucgaggagcuggagaagcuccagcgccggcacgggggcucccuggugcgcugcccccugagccggaacuccacccacgagauguacugggucagcggcgccuccgggaacaucgugagcuccgucaacacgaucagcaagaugcugcucaaccgcuucaccacccggcaccgcaagcccaccuacgagaaggacguggaccugggcgccgggacgcgguccgugagcaccgagaccgagaagccggacaugaccaucaucggccgccggcugcagcgccuccaggaggagcacaaggagacguggcacuacgaccaggagaaccccuaccggaccugggcguaccacggguccuacgaggcccccagcaccggcuccgccagcuccauggucaacggcguggugaagcugcugaccaagccgugggacgucauccccauggugacgcagcucgccaugaccgacaccacccccuucgggcagcagcgcguguucaaggagaaggucgacacgcggacgccccagccgaagcugggcacccgcaugaucaugaccacgaccgcgaacuggcugugggcccuccuggggaagaagaaguccccgcggcugugcacccgcgaggaguucaucuccaaggugcggagcaacgccgccaucggcgccguguuccaggaggagcagggguggaccuccgcgagcgaggccgucaacgacagccgcuucugggagcucguggacaaggagcgggcccugcaccaggagggcaagugcgaguccugcguguacaacaugaugggcaagcgcgagaagaagcugggggaguucggccgcgccaaggggagccgggccaucugguacauguggcucggcgcgcgcuuccuggaguucgaggcccugggguuccucaacgaggaccacugguucucccgggagaacagcugguccggcgucgagggcgaggggcugcaccgccugggcuacauccucgaggacaucgacaagaaggacggggaccugaucuacgccgacgacacggccggcugggacacccggaucaccgaggacgaccugcucaacgaggagcugaucaccgagcagauggcgccccaccacaagacgcuggcgaaggccaucuucaagcucaccuaccagaacaagguggugaagguccugcgccccacccccaagggcgccgugauggacaucaucagccggaaggaccagcgcggguccggccagguggggaccuacggccugaacaccuucacgaacauggagguccagcucauccggcagauggaggccgagggggugaucacccaggacgacaugcagaaccccaagggccugaaggagcgcguggagaaguggcugaaggagugcggcgucgaccggcucaagcgcauggcgaucagcggggacgacugcguggugaagccccuggacgagcgguucuccaccagccuccuguuccugaacgacaugggcaagguccgcaaggacgugccccagugggagccguccaagggguggaagaacuggcaggaggugcccuucugcagccaccacuuccacaagaucuucaugaaggacggccggucccuggucgugcccugccgcaaccaggacgagcucaucgggcgggcccgcaucagccagggcgccggcuggucccugcgggagaccgccugccuggggaaggccuacgcgcagauguggagccucauguacuuccaccgccgcgaccugcggcuggccuccauggccaucugcagcgccgugcccacggagugguucccgaccagccgcaccaccugguccauccacgcccagcaccaguggaugacgaccgaggacaugcucaaggucuggaaccggguguggaucgaggacaaccccaacaugaccgacaagacccccgugcacagcugggaggacauccccuaccugggcaagcgcgaggaccuguggugcgggucccucaucggccugagcucccgggcgacgugggccaagaacauccacaccgccaucacccagguccgcaaccugaucgggaaggaggaguacguggacuacaugccggugaugaagcgguacagcgcccccuccgagagcgagggcguccucuga

SEQ ID NO: 10496 - RNA, 9867 nt, Artificial Sequence
  derived and/or modified CDS sequence (opt1) from DENV-4__JQ915087__SS-prME
agcaccaugacccugcucugccugauccccaccgugauggccuuccaccugagcacccgcgacggcgagccgcucaugaucguggccaagcacgagcgggggcgcccccugcuguucaagaccaccgagggcaucaacaagugcacccucaucgcgauggaccugggggagaugugcgaggacaccgugaccuacaagugcccccugcucgugaacaccgagcccgaggacaucgacugcuggugcaaccugacgagcaccugggugauguacgggaccugcacccaguccggggagcggcgccgggagaagcgcagcguggcccugacgccgcacuccggcaugggccucgagacccgggccgagaccuggaugagcuccgagggggccuggaagcacgcccagcgcguggagagcuggauccugcggaaccccggcuucgcgcugcucgccggguucauggccuacaugaucggccagaccgggauccagcgcaucgucuucuucgugcugaugaugcugguggcccccuccuacggcaugcggugcgucggcguggggaaccgcgacuucguggagggcgucagcgggggcgcguggguggaccucgugcuggagcacggcgggugcgucacgaccauggcccagggcaagcccacccuggacuucgagcucaccaagacgaccgccaaggagguggcccugcugcggaccuacugcaucgaggccuccaucagcaacaucaccacggcgacccgcugcccgacccagggggagcccuaccucaaggaggagcaggaccagcaguacaucugccggcgcgacguggucgaccggggcugggggaacggcugcggccuguucgggaagggcgggguggugaccugcgccaaguuccugugcuccggcaagaucacggggaaccucguccagaucgagaaccuggaguacaccgugguggucaccgugcacaacggcgacacccacgccgucggcaacgacacgagcaaccacggggugaccgccaccaucacgccccggucccccagcguggaggucaagcugccggacuacggcgagcucacgcuggacugcgagccccgguccgggaucgacuucaacgagaugauccugaugaagaugaagaagaagaccuggcucgugcacaagcagugguuccuggaccugccccuccccuggaccgccggcgcggacaccagcgaggugcacuggaacuacaaggagcgcauggucaccuucaaggugccgcacgccaagcggcaggacgugacgguccuggggucccaggagggcgccaugcacagcgcccuggccggcgcgaccgagguggacagcggggacggcaaccacauguucgccgggcaccucaagugcaaggugcgcauggagaagcugcgcaucaagggcauguccuacaccaugugcagcggcaaguucuccaucgacaaggagauggccgagacccagcacgggacgaccgucgugaaggugaaguacgagggcgccggggcccccugcaagauccccaucgagauccgggacgucaacaaggagaagguggugggccgcaucaucagcuccacccccuucgcggagaacaccaacagcgucaucaacaucgagcuggagccgcccuucggggacuccuacaucgugaucggcgugggcgacagcgcccucacgcugcacugguuccggaagggguccagcaucggcaagauguucgaguccaccuaccgcggggccaagcggauggccauccugggcgagaccgcgugggacuucgggagcgucggcggccucuucaccucccuggggaaggccgugcaccagguguucggcagcgucuacacgaccauguucgggggcguguccuggaugauccgcauccugaucggguuccucgugcuguggaucggcaccaacagccggaacaccuccauggccaugacgugcaucgccgucggcgggaucacccuguuccugggcuucaccgugcaggccgacauggggugcguggucagcuggaacggcaaggagcucaagugcggguccggcaucuucgugguggacaacguccacaccuggacggagcaguacaaguuccagcccgagagccccgcgcgccuggccagcgccauccugaacgcccacaaggacggcgugugcgggauccgguccaccacccgccucgagaacgugauguggaagcagaucaccaacgagcugaacuacguccugugggagggcgggcacgaccucacggugguggccggcgacgucaagggcgugcugaccaaggggaagcgggcgcugaccccgcccgugaacgaccucaaguacagcuggaagaccuggggcaaggccaagaucuucacgcccgaggcccgcaacuccaccuuccugaucgacgggcccgacaccagcgagugcccgaacgagcggcgcgccuggaacuucuucgaggucgaggacuacggcuucgggauguucaccacgaacaucuggaugaaguuccgggagggcuccagcgaggugugcgaccaccgccugauguccgccgcgaucaaggaccagaaggccgugcacgccgacaugggcuacuggaucgagagcuccaagaaccagaccuggcagaucgagaaggccagccucaucgaggucaagaccugccuguggcccaagacccacacgcugugguccaacggggugcucgagagccagaugcugaucccccgguccuacgcgggcccguucagccagcacaacuaccgccagggguacgccacccagaccgccggccccuggcaccuggggaagcucgagaucgacuucggcgagugccccggcaccaccgugaagauccaggaggacugcgaccaccgggggcccucccugcgcacgaccaccgccagcggcaagcuggucacccaguggugcugccgcuccugcacgaugccgccccuccgguuccugggggaggacggcugcugguacgggauggagauccgcccccugagcgagaaggaggagaacauggucaagagccaggugaccgccggccagggcaccuccgagaccuucagcauggggcuccugugccugacccucuucgucgaggagugccugcggcgccgggugacccgcaagcacaugauccuggucguggugaucaccuucugcgcgaucauccucggcgggcugaccuggauggaccugcuccgggcccugaucaugcugggcgacacgauguccggccgcaucgggggccagauccaccucgccaucaugaccgucuucaagaugagccccggguacgugcugggcguguuccugcggaagcucaccucccgcgagaccgcccugauggucaucgggauggccaugacgaccguguucagcaucccgcacgaccugauggagcucaucgacggcaucucccugggccugauccuccugaagaucgugacccacuucgacaacacccaggucgggacgcuggcgcucagccugaccuucauccgguccaccacgccccuggugauggccuggcgcacgaucauggccguguucuucgucaucacccucaucccccugugccggaccagcugccugcagaagcagucccacuggguggagaucaccgcccucauccugggcgcccaggcgcugcccguguaccucaugacgcugaugaagggggccagccgccgguccuggccgcugaacgagggcaucauggccgucgggcucgugagccugcugggcuccgcccuccugaagaacgacgugccccuggcgggccccauggucgccgggggccuccugcuggccgccuacgugaugagcggguccagcgccgaccucucccuggagaaggcggccaacgugcagugggacgagauggccgacaucaccggcagcagccccaucaucgaggucaagcaggacgaggacggguccuucagcauccgcgacguggaggagaccaacaugaucacccugcucgugaagcuggcccugaucacggucuccggccucuacccgcuggccauccccgugaccauggcgcugugguacaucuggcaggucaagacccagcggagcggcgcccucugggacguccccucccccgccgccacccagaaggccacgcugagcgaggggguguaccgcaucaugcagcggggccuguucgggaagacccaggugggcgucgggauccacauggagggcguguuccacaccauguggcacgugacccgcggcuccgucaucugccacgagaccgggcggcucgagccgagcugggcggacgugcgcaacgacaugaucuccuacggcgggggcuggcgccugggcgacaagugggacaaggaggaggacgugcagguccuggccaucgagcccgggaagaacccccggcacgugcagacgaagcccggccucuucaagacccugaccggggagaucggcgccgugacccuggacuucaagccggggacgagcggcucccccaucaucaacaagaagggcaaggucaucgggcucuacggcaacgggguggugaccaagagcggcgacuacgucuccgccaucacccaggccgagcgcaucggggagcccgacuacgagguggacgaggacaucuuccggaagaagcgccugaccaucauggaccugcacccgggcgcgggcaagacgaagcggauccuccccagcaucgugcgcgaggcccugaagcggcgccugcggacccucauccuggcccccacccgcgucguggccgcggagauggaggaggcccugcgggggcugcccauccgcuaccagaccccggccgugaaguccgagcacacgggccgggagaucgucgaccucaugugccacgccaccuucaccacccgccugcugagcuccacgcgggugcccaacuacaaccucaucgugauggacgaggcccacuucaccgaccccugcagcgucgcggcccgcggguacaucuccacccggguggagaugggcgaggccgccgccaucuucaugaccgcgacgcccccggggagcaucgaccccuucccccagagcaacucccccaucgaggacaucgagcgcgagaucccggagcggagcuggaacaccggcuucgacuggaucaccgacuaccagggcaagaccgucugguucgugcccuccaucaaggccgggaacgacaucgccaacugccugcgcaagagcggcaagcgcgugauccagcugucccggaagacguucgacaccgaguaccccaagaccaagcucaccgacugggacuucgucgugacgaccgacaucagcgagaugggggccaacuuccgcgccggccgggugaucgacccccgccggugccugaagccggucauccugaccgacgggcccgagcgcgugauccucgcgggccccauccccgugaccccggccuccgccgcccagcggcgcggccggaucgggcgcaaccccgcgcaggaggacgaccaguacgucuucagcggcgacccccugaagaacgacgaggaccacgcccacuggacggaggccaagaugcugcucgacaacaucuacacccccgaggggaucaucccgacccuguucggccccgagcgggagaagacccaggccaucgacggcgaguuccgccugcgcggggagcagcgcaagacguucguggagcucaugcggcgcggcgaccugcccguguggcuguccuacaaggucgccagcgcggggaucuccuacaaggaccgggaguggugcuucaccggcgagcgcaacaaccagauccucgaggagaacauggagguggagaucuggacccgggagggggagaagaagaagcugcgccccaaguggcuggacgcccggguguacgccgacccgauggcccucaaggacuucaaggaguucgccagcggccgcaaguccaccacgcuggacauccugaccgagaucgcgacccuccccaccuaccugagcuccaaggccaagcuggcccucgacaacaucgucaugcugcacaccacggagaagggcgggcgcgccuaccagcacgcccugaacgagcuccccgagagccuggagacccugaugcucguggcgcugcugggcgccaugaccgccgggaucuuccucuucuucaugcagggcaaggggaucggcaagcuguccaugggccugaucgccaucgcgguggccagcgggcuccugugggucgccgagauccagccgcaguggaucgccgccuccaucauccuggaguucuuccucauggugcugcugauccccgagcccgagaagcagcggacgccccaggacaaccagcucaucuacgugauccugacgauccugaccaucaucggccucaucgcggccaacgagauggggcugaucgagaagaccaagaccgacuucggcuucuaccaggucaagacggagaccaccauccuggacguggaccuccgcccggccagcgccuggacccuguacgccguggcgacgaccauccugacccccaugcuccggcacaccaucgagaacacgagcgccaaccugucccuggccgccaucgccaaccaggcggccguccucauggggcugggcaagggcuggccccugcaccgcauggaccucggggugccccugcuggccaugggcugcuacagccaggugaacccgaccacccucaccgccucccuggucaugcugcucauccacuacgccaucaucgggcccggccugcaggcgaaggccacgcgggaggcccagaagcgcaccgccgcgggcaucaugaagaaccccaccguggacgggaucaccgugaucgaccuggagcccaucagcuacgacccgaaguucgagaagcagcucggccaggucaugcugcuggugcucugcguggggcagcugcugcucaugcggacgaccugggcccugugcgagguccugacccucgccaccggccccaucaugacgcugugggaggggaaccccggccgcuucuggaacaccaccaucgccguguccaccgccaacaucuuccggggcagcuaccuggcgggggccggccucgccuucucccugaucaagaacgcccagacgccccgccgggggaccggcaccaccggggagacgcugggcgagaaguggaagcgccagcucaacagccuggaccggaaggaguucgaggaguacaagcgcuccggcauccuggagguggaccggaccgaggccaagagcgcgcuccgcgacggguccaagaucaagcacgccgucagccggggcuccagcaagauccgcuggaucguggagcgggggaugaucaagccgaagggcaagguggucgaccuggggugcggccgcggcgggugguccuacuacauggccacccugaagaacgugaccgaggugaagggcuacaccaagggcggccccgggcacgaggagcccauccccauggccacguacggcuggaaccucgucaagcugcacagcggcguggacguguucuacaagccgaccgagcaggucgacacccugcucugcgacaucggggaguccagcuccaaccccaccaucgaggagggccgcacgcugcggauccugaagaugguggagcccuggcucagcagcaagcccgaguucugcaucaaggugcugaacccguacaugcccaccgucaucgaggagcuggagaagcuccagcgccggcacgggggcucccuggugcgcugcccccugagccggaacuccacccacgagauguacugggugagcggcgccuccgggaacaucgucagcuccgugaacaccaucagcaagaugcugcucaaccgcuucacgacccggcaccgcaagcccaccuacgagaaggacgucgaccugggcgcggggacccgguccgugagcacggagaccgagaagccggacaugaccaucaucggccgccggcugcagcgccuccaggaggagcacaaggagaccuggcacuacgaccaggagaaccccuaccggacgugggccuaccacggguccuacgaggcccccagcaccggcuccgccagcuccauggugaacggcgucgugaagcugcugaccaagccgugggacgugauccccauggucacccagcucgcgaugacggacaccacccccuucgggcagcagcgcguguucaaggagaagguggacacccggacgccccagccgaagcugggcacccgcaugaucaugaccaccacggccaacuggcugugggcccuccuggggaagaagaaguccccgcggcugugcacccgcgaggaguucaucuccaagguccggagcaacgccgccaucggcgcgguguuccaggaggagcagggguggaccuccgccagcgaggccgugaacgacagccgcuucugggagcucgucgacaaggagcgggcccugcaccaggagggcaagugcgaguccugcguguacaacaugaugggcaagcgcgagaagaagcugggggaguucggccgcgccaaggggagccgggcgaucugguacauguggcucggcgcccgcuuccuggaguucgaggcccugggguuccucaacgaggaccacugguucucccgggagaacagcugguccggcguggagggcgaggggcugcacagccugggcuacauccucgaggacaucgacaagaaggacggggaccugaucuacgccgacgacaccgccggcugggacacgcgcaucaccgaggacgaccugcucaacgaggagcugaucaccgagcagauggcgccccaccacaagacccuggccaaggccaucuucaagcucacguaccagaacaaggucgugaaggugcugcggcccacccccaagggcgccgucauggacaucaucucccgcaaggaccagcgggggagcggccagguggggaccuacggccugaacaccuucaccaacauggaggugcagcucauccgccagauggaggcggagggggucaucacgcaggacgacaugcagaaccccaagggccugaaggagcggguggagaaguggcugaaggagugcggcguggaccgccucaagcggauggccaucuccggggacgacugcgucgugaagccccuggacgagcgcuucagcaccucccuccuguuccugaacgacaugggcaaggugcggaaggacgucccccagugggagccgagcaagggguggaagaacuggcaggaggugcccuucugcucccaccacuuccacaagaucuucaugaaggacggccgcagccuggugguccccugccggaaccaggacgagcucaucgggcgcgcccggaucucccagggcgccggcuggagccugcgcgagaccgccugccuggggaaggcguacgcccagauguggucccucauguacuuccaccggcgcgaccugcgccuggccagcauggccaucugcagcgccgugcccaccgagugguucccgacgucccggaccaccuggagcauccacgcgcagcaccaguggaugaccacggaggacaugcucaagguguggaaccgcgucuggaucgaggacaaccccaacaugaccgacaagacccccgugcacuccugggaggacauccccuaccugggcaagcgggaggaccuguggugcgggagccucaucggccuguccagccgcgccaccugggccaagaacauccacacggccaucacccaggugcggaaccugaucgggaaggaggaguacgucgacuacaugccggugaugaagcgcuacuccgcccccagcgaguccgagggcgugcucuga

SEQ ID NO: 10497 - RNA, 9867 nt, Artificial Sequence
  derived and/or modified CDS sequence (opt1) from DENV-4__JQ915089__SS-prME
agcaccaugacccugcucugccugauccccaccgugauggccuuccaccuguccacccgcgacggcgagccgcucaugaucguggccaagcacgagcgggggcgcccccugcuguucaagaccaccgagggcaucaacaagugcacccucaucgcgauggaccugggggagaugugcgaggacaccgugaccuacaagugcccccugcucgugaacaccgagcccgaggacaucgacugcuggugcaaccugacgagcaccugggucauguacgggaccugcacccaguccggggagcggcgccgggagaagcgcagcguggcccugacgccgcacuccggcaugggccucgagacccgggccgagaccuggaugagcuccgagggggccuggaagcacgcccagcgcguggagagcuggauccugcggaaccccggcuucgcgcugcucgccggguucauggccuacaugaucggccagaccgggauccagcgcacggucuucuucgugcugaugaugcugguggcccccuccuacggcaugcggugcgucggcguggggaaccgcgacuucguggagggcgucagcgggggcgcguggguggaccucgugcuggagcacggcgggugcgucaccaccauggcccagggcaagcccacccuggacuucgagcucacgaagaccaccgccaaggagguggcccugcugcggaccuacugcaucgaggccuccaucagcaacaucacgaccgcgacccgcugcccgacccagggggagcccuaccucaaggaggagcaggaccagcaguacaucugccggcgcgacguggucgaccggggcugggggaacggcugcggccuguucgggaagggcgggguggugacgugcgccaaguuccugugcuccggcaagaucaccgggaaccucguccagaucgagaaccuggaguacaccgugguggucaccgugcacaacggcgacacgcacgccgucggcaacgacaccagcaaccacggggugaccgccaccaucacgccccgcucccccagcguggaggucaagcugccggacuacggcgagcucacccuggacugcgagccccgguccgggaucgacuucaacgagaugauccugaugaagaugaagaagaagaccuggcucgugcacaagcagugguuccuggaccugccccuccccuggaccgccggcgcggacaccagcgaggugcacuggaacuacaaggagcgcauggucacguucaaggugccgcacgccaagcggcaggacgugaccguccuggggucccaggagggcgccaugcacagcgcccuggccggcgcgaccgagguggacagcggggacggcaaccacauguucgccgggcaccucaagugcaaggugcgcauggagaagcugcgcaucaagggcauguccuacaccaugugcagcggcaaguucuccaucgacaaggagauggccgagacgcagcacgggaccaccgucgugaaggugaaguacgagggcgccggggcccccugcaagauccccaucgagauccgggacgucaacaaggagaagguggugggccgcaucaucagcuccacccccuucgcggagaacacgaacagcgucaucaacaucgagcuggagccgcccuucggggacuccuacaucgugaucggcgugggcgacagcgcccucacccugcacugguuccggaagggguccagcaucggcaagauguucgaguccaccuaccgcggggccaagcggauggccauccugggcgagaccgcgugggacuucgggagcgucggcggccucuucacgucccuggggaaggccgugcaccagguguucggcagcgucuacaccaccauguucgggggcguguccuggaugauccgcauccugaucggguuccucgugcuguggaucggcaccaacagccggaacacguccauggccaugaccugcaucgccgucggcgggaucacccuguuccugggcuucaccgugcaggccgacauggggugcguggucagcuggaacggcaaggagcucaagugcggguccggcaucuucgugguggacaacguccacacguggaccgagcaguacaaguuccagcccgagagccccgcgcgccuggccagcgccauccugaacgcccacaaggacggcgugugcgggauccgguccaccacccgccucgagaacgugauguggaagcagaucacgaacgagcugaacuacguccugugggagggcgggcacgaccucaccgugguggccggcgacgucaagggcgugcugaccaaggggaagcgggugcugaccccgcccgucaacgaccucaaguacagcuggaagacguggggcaaggcgaagaucuucacccccgaggcccgcaacuccaccuuccugaucgacgggcccgacaccagcgagugcccgaacgagcggcgcgccuggaacuucuucgagguggaggacuacggcuucgggauguucacgaccaacaucuggaugaaguuccgggagggcuccagcgaggugugcgaccaccgccugauguccgccgccaucaaggaccagaaggcgguccacgccgacaugggcuacuggaucgagagcuccaagaaccagaccuggcagaucgagaaggccagccucaucgaggugaagaccugccuguggcccaagacgcacacccugugguccaacggggugcucgagagccagaugcugaucccccgguccuacgccggcccguucagccagcacaacuaccgccagggguacgcgacccagaccgccggccccuggcaccuggggaagcucgagaucgacuucggcgagugccccggcaccacggucaagauccaggaggacugcgaccaccgggggcccucccugcgcaccaccaccgccagcggcaagcuggugacgcaguggugcugccgcuccugcaccaugccgccccuccgguuccugggggaggacggcugcugguacgggauggagauccgcccccugagcgagaaggaggagaacauggugaagucccaggucaccgccggccagggcaccuccgagacguucagcauggggcuccugugccugacccucuucguggaggagugccugcggcgccgggucacccgcaagcacaugauccuggugguggucaucaccuucugcgccaucauccucggcgggcugacguggauggaccugcuccgggcgcugaucaugcugggcgacaccauguccggccgcaucgggggccagauccaccucgccaucaugaccguguucaagaugagccccggguacgugcugggcgucuuccugcggaagcucaccucccgcgagacggcccugauggugaucgggauggccaugaccaccguguucagcaucccgcacgaccugauggagcucaucgacggcaucucccugggccugauccuccugaagaucgucacccacuucgacaacacccagguggggacccuggcccucagccugaccuucauccgguccaccacgccccuggugauggcguggcgcaccaucauggccgucuucuucgugaucacccucaucccccugugccggaccagcugccugcagaagcagucccacuggguggagaucacggcccucauccugggcgcccaggcccugcccgucuaccucaugacccugaugaagggggcgagcucccgcagcuggccgcugaacgagggcaucauggccguggggcucgugucccugcugggcagcgcccuccugaagaacgacgucccccuggccggccccaugguggccgggggccuccugcuggccgccuacgugauguccgggagcuccgccgaccucagccuggagaaggccgcgaacguccagugggacgagauggccgacaucaccggcagcucccccaucaucgaggugaagcaggacgaggacgggagcuucuccauccgggacguggaggagaccaacaugaucacgcugcucgucaagcuggcccugaucaccgugagcggccucuacccgcuggccauccccgugaccauggcccugugguacaucuggcaggucaagacccagcgcuccggcgcgcucugggacgugcccagccccgccgccacgcagaaggccacccuguccgaggggguguaccggaucaugcagcgcggccuguucgggaagacccaggucggcguggggauccacauggagggcguguuccacaccauguggcacgucacccggggcagcgugaucugccacgagacggggcgccucgagccguccugggccgacgugcggaacgacaugaucagcuacggcgggggcuggcgccugggcgacaagugggacaaggaggaggacguccaggugcuggcgaucgagcccgggaagaacccccgccacgugcagaccaagcccggccucuucaagacccugaccggggagaucggcgccgucacgcuggacuucaagccggggaccuccggcagccccaucaucaacaagaagggcaaggugaucgggcucuacggcaacgggguggucaccaaguccggcgacuacgugagcgccaucacccaggccgagcggaucggggagcccgacuacgagaucgacgaggacaucuuccgcaagaagcggcugacgaucauggaccugcacccgggcgccggcaagaccaagcgcauccuccccuccaucgugcgggaggcgcugaagcgccggcugcgcacccucauccuggcccccacccgggucguggccgccgagauggaggaggcgcugcgcgggcugcccauccgguaccagacgccggccgucaagagcgagcacaccggccgcgagaucgucgaccucaugugccacgccaccuucaccacgcggcugcuguccagcacccgcgugcccaacuacaaccucaucgugauggacgaggcccacuucaccgaccccugcuccgucgccgcgcggggguacaucagcacccgcguggagaugggcgaggccgccgccaucuucaugacggccacgcccccggggagcaucgaccccuucccccaguccaacagccccaucgaggacaucgagcgggagaucccggagcgcuccuggaacaccggcuucgacuggaucaccgacuaccagggcaagacggucugguucgugcccagcaucaaggcggggaacgacaucgccaacugccugcggaaguccggcaagcgcgugauccagcugagccgcaagaccuucgacaccgaguaccccaagaccaagcucacggacugggacuucgucgugaccaccgacaucuccgagaugggggccaacuuccgggccggccgcgugaucgacccccggcgcugccugaagccggucauccugaccgacgggcccgagcgggugauccucgccggccccauccccgugacgccggcgagcgccgcccagcgccggggccgcaucgggcggaaccccgcccaggaggacgaccaguacgucuucuccggcgacccccugaagaacgacgaggaccacgcgcacuggaccgaggccaagaugcugcucgacaacaucuacacccccgaggggaucaucccgacccuguucggccccgagcgcgagaagacgcaggccaucgacggcgaguuccggcugcgcggggagcagcggaagaccuucguggagcucaugcgccggggcgaccugcccguguggcugagcuacaaggucgccuccgccgggaucagcuacaaggaccgcgaguggugcuucaccggcgagcggaacaaccagauccucgaggagaacauggagguggagaucuggacccgcgagggggagaagaagaagcugcggcccaaguggcuggacgcgcgcguguacgccgacccgauggcccucaaggacuucaaggaguucgccuccggccgcaagagcacgacccuggacauccugaccgagaucgccacccuccccaccuaccuguccagcaaggcgaagcuggcccucgacaacaucgucaugcugcacacgaccgagaagggcgggcgcgccuaccagcacgcccugaacgagcuccccgagucccuggagacccugaugcucguggcccugcugggcgcgaugaccgccgggaucuuccucuucuucaugcagggcaaggggaucggcaagcugagcaugggccugaucgccaucgccguggcguccgggcuccugugggucgccgagauccagccgcaguggaucgccgccagcaucauccuggaguucuuccucauggugcugcugauccccgagcccgagaagcagcgcacgccccaggacaaccagcucaucuacgugauccugaccauccugaccaucaucggccucaucgccgcgaacgagauggggcugaucgagaagaccaagacggacuucggcuucuaccaggucaagaccgagaccaccauccuggacguggaccuccggccggccagcgccuggacgcuguacgccguggccaccaccauccugacccccaugcuccgccacacgaucgagaacaccuccgcgaaccugagccuggccgccaucgccaaccaggccgcgguccucauggggcugggcaagggcuggccccugcaccggauggaccucggggugccccugcuggccaugggcugcuacucccaggugaacccgaccacccucacggccagccuggucaugcugcucauccacuacgccaucaucgggcccggccugcaggccaaggcgacccgcgaggcccagaagcggaccgccgccggcaucaugaagaaccccaccguggacgggaucacggugaucgaccuggagcccaucuccuacgacccgaaguucgagaagcagcucggccaggucaugcugcuggugcucugcguggggcagcugcugcucaugcgcaccaccugggcgcugugcgagguccugacccucgccacgggccccaucaugacccugugggaggggaaccccggccgguucuggaacaccaccaucgccgugagcacggccaacaucuuccgcggcuccuaccuggccggggcgggccucgccuucagccugaucaagaacgcccagacgccccggcgcgggaccggcaccacgggggagacccugggcgagaaguggaagcggcagcucaacucccuggaccgcaaggaguucgaggaguacaagcggagcggcauccuggagguggaccgcaccgaggccaaguccgcccuccgggacgggagcaagaucaagcacgcggucucccgcggcagcuccaagauccgguggaucguggagcgcgggaugaucaagccgaagggcaagguggucgaccuggggugcggccggggcggguggagcuacuacauggccacccugaagaacgugaccgaggugaagggcuacacgaagggcggccccgggcacgaggagcccauccccauggccaccuacggcuggaaccucgucaagcugcacuccggcguggacguguucuacaagccgaccgagcaggucgacacccugcucugcgacaucggggagagcuccagcaaccccacgaucgaggagggccgcacccugcgcauccugaagaugguggagcccuggcucagcuccaagcccgaguucugcaucaaggugcugaacccguacaugcccaccgucaucgaggagcuggagaagcuccagcggcgccacgggggcagccuggugcggugcccccugucccgcaacagcacccacgagauguacuggguguccggcgccagcgggaacaucgucuccagcgugaacacgaucuccaagaugcugcucaaccgguucaccacccgccaccggaagcccaccuacgagaaggacgucgaccugggcgccgggacgcgcagcguguccaccgagaccgagaagccggacaugaccaucaucggccggcgccugcagcggcuccaggaggagcacaaggagacguggcacuacgaccaggagaaccccuaccgcaccugggcguaccacgggagcuacgaggcccccuccaccggcagcgccuccagcauggugaacggcgucgugaagcugcugaccaagccgugggacgugauccccauggucacgcagcucgccaugaccgacaccacccccuucgggcagcagcggguguucaaggagaagguggacacgcgcacgccccagccgaagcugggcacccggaugaucaugaccacgaccgcgaacuggcugugggcccuccuggggaagaagaaguccccgcggcugugcacccgggaggaguucaucagcaagguccgcagcaacgccgccaucggcgccguguuccaggaggagcagggguggaccagcgcgagcgaggccgugaacgacucccgguucugggagcucgucgacaaggagcgcgcccugcaccaggagggcaagugcgagagcugcguguacaacaugaugggcaagcgggagaagaagcugggggaguucggccgcgccaaggggucccgcgccaucugguacauguggcucggcgcgcgguuccuggaguucgaggcccugggguuccucaacgaggaccacugguucagccgcgagaacuccuggagcggcguggagggcgaggggcugcaccggcugggcuacauccucgaggacaucgacaagaaggacggggaccugaucuacgccgacgacacggccggcugggacacccgcaucaccgaggacgaccugcucaacgaggagcugaucaccgagcagauggcgccccaccacaagacgcuggcgaaggccaucuucaagcucaccuaccagaacaaggucgugaaggugcugcggcccacccccaagggcgccgucauggacaucaucucccgcaaggaccagcgggggagcggccagguggggaccuacggccugaacaccuucacgaacauggaggugcagcucauccgccagauggaggccgagggggucaucacccaggacgacaugcagaaccccaagggccugaaggagcggguggagaaguggcugaaggagugcggcguggaccgccucaagcggauggcgaucuccggggacgacugcgucgugaagccccuggacgagcgcuucagcaccucccuccuguuccugaacgacaugggcaaggugcggaaggacgucccccagugggagccgagcaagggguggaagaacuggcaggaggugcccuucugcucccaccacuuccacaagaucuucaugaaggacggccgcagccuggugguccccugccggaaccaggacgagcucaucgggcgcgcccggaucucccagggcgccggcuggagccugcgcgagaccgccugccuggggaaggccuacgcgcagauguggucccucauguacuuccaccggcgcgaccugcgccuggccagcauggccaucugcagcgccgugcccacggagugguucccgaccucccggaccaccuggagcauccacgcccagcaccaguggaugacgaccgaggacaugcucaagguguggaaccgcgucuggaucgaggacaaccccaacaugaccgacaagacccccgugcacuccugggaggacauccccuaccugggcaagcgggaggaccuguggugcgggagccucaucggccuguccagccgcgcgacgugggccaagaacauccacaccgccaucacccaggugcggaaccugaucgggaaggaggaguacgucgacuacaugccggugaugaagcgcuacuccgcccccagcgaguccgagggcgugcucuga

SEQ ID NO: 10498 - RNA, 9867 nt, Artificial Sequence
  derived and/or modified CDS sequence (opt1) from DENV-4__JQ915082__SS-prME
agcaccaugacccugcucugccugauccccaccgugauggccuuccaccugagcacccgcgacggcgagccgcucaugaucguggccaagcacgagcgggggcgcccccugcuguucaagaccaccgagggcaucaacaagugcacccucaucgcgauggaccugggggagaugugcgaggacaccgugaccuacaagugcccccugcucgugaacaccgagcccgaggacaucgacugcuggugcaaccugaccagcaccugggugauguacgggaccugcacccaguccggggagcggcgccgggagaagcgcagcguggcccugacgccgcacuccggcaugggccucgagacccgggccgagaccuggaugagcuccgagggggccuggaagcacgcccagcgcguggagagcuggauccugcggaaccccggcuucgcgcugcucgccggguucauggccuacaugaucggccagaccgggauccagcgcaucgucuucuucgugcugaugaugcugguggcccccuccuacggcaugcggugcgucggcguggggaaccgcgacuucguggagggcgucagcgggggcgcguggguggaccucgugcuggagcacggcgggugcgucacgaccauggcccagggcaagcccacccuggacuucgagcucaccaagacgaccgccaaggagguggcccugcugcggaccuacugcaucgaggccuccaucagcaacaucaccacggcgacccgcugcccgacccagggggagcccuaccucaaggaggagcaggaccagcaguacaucugccggcgcgacguggucgaccggggcugggggaacggcugcggccuguucgggaagggcgggguggugaccugcgccaaguuccugugcuccggcaagaucacggggaaccucguccagaucgagaaccuggaguacaccgugguggucaccgugcacaacggcgacacccacgccgucggcaacgacacgagcaaccacggggugaccgccaccaucacgccccggucccccagcguggaggucaagcugccggacuacggcgagcucacgcuggacugcgagccccgguccgggaucgacuucaacgagaugauccugaugaagaugaagaagaagaccuggcucgugcacaagcagugguuccuggaccugccccuccccuggaccgccggcgcggacaccagcgaggugcacuggaacuacaaggagcgcauggucaccuucaaggugccgcacgccaagcggcaggacgugacgguccuggggucccaggagggcgccaugcacagcgcccuggccggcgcgaccgagguggacagcggggacggcaaccacauguucgccgggcaccucaagugcaaggugcgcauggagaagcugcgcaucaagggcauguccuacaccaugugcagcggcaaguucuccaucgacaaggagauggccgagacccagcacgggacgaccgucgugaaggugaaguacgagggcgccggggcccccugcaagauccccaucgagauccgggacgucaacaaggagaagguggugggccgcaucaucagcuccacccccuucgcggagaacaccaacagcgucaucaacaucgagcuggagccgcccuucggggacuccuacaucgugaucggcgugggcgacagcgcccucacgcugcacugguuccggaagggguccagcaucggcaagauguucgaguccaccuaccgcggggccaagcggauggccauccugggcgagaccgcgugggacuucgggagcgucggcggccucuucaccucccuggggaaggccgugcaccagguguucggcagcgucuacacgaccauguucgggggcguguccuggaugauccgcauccugaucggguuccucgugcuguggaucggcaccaacagccggaacaccuccauggccaugacgugcaucgccgucggcgggaucacccuguuccugggcuucaccgugcaggccgacauggggugcguggucagcuggaacggcaaggagcucaagugcggguccggcaucuucgugguggacaacguccacaccuggacggagcaguacaaguuccagcccgagagccccgcgcgccuggccagcgccauccugaacgcccacaaggacggcgugugcgggauccgguccaccacccgccucgagaacgugauguggaagcagaucaccaacgagcugaacuacguccugugggagggcgggcacgaccucacggugguggccggcgacgucaagggcgugcugaccaaggggaagcgggcgcugaccccgcccgugaacgaccucaaguacagcuggaagaccuggggcaaggccaagaucuucacgcccgaggcccgcaacuccaccuuccugaucgacgggcccgacaccagcgagugcccgaacgagcggcgcgccuggaacuucuucgaggucgaggacuacggcuucgggauguucaccacgaacaucuggaugaaguuccgggagggcuccagcgaggugugcgaccaccgccugauguccgccgcgaucaaggaccagaaggccgugcacgccgacaugggcuacuggaucgagagcuccaagaaccagaccuggcagaucgagaaggccagccucaucgaggucaagaccugccuguggcccaagacccacacgcugugguccaacggggugcucgagagccagaugcugaucccccgguccuacgcgggcccguucagccagcacaacuaccgccagggguacgccacccagaccgccggccccuggcaccuggggaagcucgagaucgacuucggcgagugccccggcaccaccgugaagauccaggaggacugcgaccaccgggggcccucccugcgcacgaccaccgccagcggcaagcuggucacccaguggugcugccgcuccugcacgaugccgccccuccgguuccugggggaggacggcugcugguacgggauggagauccgcccccugagcgagaaggaggagaacauggucaagagccaggugaccgccggccagggcaccuccgagaccuucagcauggggcuccugugccugacccucuucgucgaggagugccugcggcgccgggugacccgcaagcacaugauccuggucguggugaucaccuucugcgcgaucauccucggcgggcugaccuggauggaccugcuccgggcccugaucaugcugggcgacacgauguccggccgcaucgggggccagauccaccucgccaucaugaccgucuucaagaugagccccggguacgugcugggcguguuccugcggaagcucaccucccgcgagaccgcccugauggucaucgggauggccaugacgaccguguucagcaucccgcacgaccugauggagcucaucgacggcaucucccugggccugauccuccugaagaucgugacccacuucgacaacacccaggucgggacgcuggcgcucagccugaccuucauccgguccaccacgccccuggugauggccuggcgcacgaucauggccguguucuucgucaucacccucaucccccugugccggaccagcugccugcagaagcagucccacuggguggagaucaccgcccucauccugggcgcccaggcgcugcccguguaccucaugacgcugaugaagggggccagccgccgguccuggccgcugaacgagggcaucauggccgucgggcucgugagccugcugggcuccgcccuccugaagaacgacgugccccuggcgggccccauggucgccgggggccuccugcuggccgccuacgugaugagcggguccagcgccgaccucucccuggagaaggcggccaacgugcagugggacgagauggccgacaucaccggcagcagccccaucaucgaggucaagcaggacgaggacggguccuucagcauccgcgacguggaggagaccaacaugaucacccugcucgugaagcuggcccugaucacggucuccggccucuacccgcuggccauccccgugaccauggcgcugugguacaucuggcaggucaagacccagcggagcggcgcccucugggacguccccucccccgccgccacccagaaggccacgcugagcgaggggguguaccgcaucaugcagcggggccuguucgggaagacccaggugggcgucgggauccacauggagggcguguuccacaccauguggcacgugacccgcggcuccgucaucugccacgagaccgggcggcucgagccgagcugggcggacgugcgcaacgacaugaucuccuacggcgggggcuggcgccugggcgacaagugggacaaggaggaggacgugcagguccuggccaucgagcccgggaagaacccccggcacgugcagacgaagcccggccucuucaagacccugaccggggagaucggcgccgugacccuggacuucaagccggggacgagcggcucccccaucaucaacaagaagggcaaggucaucgggcucuacggcaacgggguggugaccaagagcggcgacuacgucuccgccaucacccaggccgagcgcaucggggagcccgacuacgagguggacgaggacaucuuccggaagaagcgccugaccaucauggaccugcacccgggcgcgggcaagacgaagcggauccuccccagcaucgugcgcgaggcccugaagcggcgccugcggacccucauccuggcccccacccgcgucguggccgcggagauggaggaggcccugcgggggcugcccauccgcuaccagaccccggccgugaaguccgagcacacgggccgggagaucgucgaccucaugugccacgccaccuucaccacccgccugcugagcuccacgcgggugcccaacuacaaccucaucgugauggacgaggcccacuucaccgaccccugcagcgucgcggcccgcggguacaucuccacccggguggagaugggcgaggccgccgccaucuucaugaccgcgacgcccccggggagcaucgaccccuucccccagagcaacucccccaucgaggacaucgagcgcgagaucccggagcggagcuggaacaccggcuucgacuggaucaccgacuaccagggcaagaccgucugguucgugcccuccaucaaggccgggaacgacaucgccaacugccugcgcaagagcggcaagcgcgugauccagcugucccggaagacguucgacaccgaguaccccaagaccaagcucaccgacugggacuucgucgugacgaccgacaucagcgagaugggggccaacuuccgcgccggccgggugaucgacccccgccggugccugaagccggucauccugaccgacgggcccgagcgcgugauccucgcgggccccauccccgugaccccggccuccgccgcccagcggcgcggccggaucgggcgcaaccccgcgcaggaggacgaccaguacgucuucagcggcgacccccugaagaacgacgaggaccacgcccacuggacggaggccaagaugcugcucgacaacaucuacacccccgaggggaucaucccgacccuguucggccccgagcgggagaagacccaggccaucgacggcgaguuccgccugcgcggggagcagcgcaagacguucguggagcucaugcggcgcggcgaccugcccguguggcuguccuacaaggucgccagcgcggggaucuccuacaaggaccgggaguggugcuucaccggcgagcgcaacaaccagauccucgaggagaacauggagguggagaucuggacccgggagggggagaagaagaagcugcgccccaaguggcuggacgcccggguguacgccgacccgauggcccucaaggacuucaaggaguucgccagcggccgcaaguccaccacgcuggacauccugaccgagaucgcgacccuccccaccuaccugagcuccaaggccaagcuggcccucgacaacaucgucaugcugcacaccacggagaagggcgggcgcgccuaccagcacgcccugaacgagcuccccgagagccuggagacccugaugcucguggcgcugcugggcgccaugaccgccgggaucuuccucuucuucaugcagggcaaggggaucggcaagcuguccaugggccugaucgccaucgcgguggccagcgggcuccugugggucgccgagauccagccgcaguggaucgccgccuccaucauccuggaguucuuccucauggugcugcugauccccgagcccgagaagcagcggacgccccaggacaaccagcucaucuacgugauccugacgauccugaccaucaucggccucaucgcggccaacgagauggggcugaucgagaagaccaagaccgacuucggcuucuaccaggucaagacggagaccaccauccuggacguggaccuccgcccggccagcgccuggacccuguacgccguggcgacgaccauccugacccccaugcuccggcacaccaucgagaacaugagcgccaaccugucccuggccgccaucgccaaccaggcggccguccucauggggcugggcaagggcuggccccugcaccgcauggaccucggggugccccugcuggccaugggcugcuacagccaggugaacccgacgacccucaccgccucccuggucaugcugcucauccacuacgccaucaucgggcccggccugcaggcgaaggccacccgggaggcccagaagcgcacggccgcgggcaucaugaagaaccccaccguggacgggaucaccgugaucgaccuggagcccaucagcuacgacccgaaguucgagaagcagcucggccaggucaugcugcuggugcucugcguggggcagcugcugcucaugcggaccacgugggcccugugcgagguccugacccucgccaccggccccaucaucacccugugggaggggaaccccggccgcuucuggaacacgaccaucgccguguccaccgccaacaucuuccggggcagcuaccuggcgggggccggccucgccuucucccugaucaagaacgcccagacgccccgccgggggacgggcaccaccggggagacccugggcgagaaguggaagcgccagcucaacagccuggaccggaaggaguucgaggaguacaagcgcuccggcauccuggagguggaccggacggaggccaagagcgcgcuccgcgacggguccaagaucaagcacgccgucagccggggcuccagcaagauccgcuggaucguggagcgggggaugaucaagccgaagggcaagguggucgaccuggggugcggccgcggcgggugguccuacuacauggccacccugaagaacgugaccgaggugaagggcuacaccaagggcggccccgggcacgaggagcccauccccauggccaccuacggcuggaaccucgucaagcugcacagcggcguggacguguucuacaagccgacggagcaggucgacacccugcucugcgacaucggggaguccagcuccaaccccaccaucgaggagggccgcacccugcggauccugaagaugguggagcccuggcucagcagcaagcccgaguucugcaucaaggugcugaacccguacaugcccacggucaucgaggagcuggagaagcuccagcgccggcacgggggcucccuggugcgcugcccccugagccggaacuccacccacgagauguacugggugagcggcgccuccgggaacaucgucagcuccgugaacaccaucagcaagaugcugcucaaccgcuucaccacgcggcaccgcaagcccaccuacgagaaggacgucgaccugggcgcggggacccgguccgugagcaccgagacggagaagccggacaugaccaucaucggccgccggcugcagcgccuccaggaggagcacaaggagaccuggcacuacgaccaggagaaccccuaccggaccugggccuaccacggguccuacgaggcccccagcacgggcuccgccagcuccauggugaacggcgucgugaagcugcugaccaagccgugggacgugauccccauggucacccagcucgcgaugaccgacacgacccccuucgggcagcagcgcguguucaaggagaagguggacacccggacgccccagccgaagcugggcacgcgcaugaucaugaccaccaccgccaacuggcugugggcccuccuggggaagaagaaguccccgcggcugugcacgcgcgaggaguucaucuccaagguccggagcaacgccgccaucggcgcgguguuccaggaggagcagggguggaccuccgccagcgaggccgugaacgacagccgcuucugggagcucgucgacaaggagcgggcccugcaccaggagggcaagugcgaguccugcguguacaacaugaugggcaagcgcgagaagaagcugggggaguucggccgcgccaaggggagccgggcgaucugguacauguggcucggcgcccgcuuccuggaguucgaggcccugggguuccucaacgaggaccacugguucucccgggagaacagcugguccggcguggagggcgaggggcugcaccgccugggcuacauccucgaggacaucgacaagaaggacggggaccugaucuacgccgacgacaccgccggcugggacacccggaucacggaggacgaccugcucaacgaggagcugaucaccgagcagauggcgccccaccacaagacccuggccaaggccaucuucaagcucaccuaccagaacaaggucgugaaggugcugcgccccacgcccaagggcgccgucauggacaucaucagccggaaggaccagcgcggguccggccagguggggaccuacggccugaacaccuucaccaacauggaggugcagcucauccggcagauggaggcggagggggucaucacccaggacgacaugcagaaccccaagggccugaaggagcgcguggagaaguggcugaaggagugcggcguggaccggcucaagcgcauggccaucagcggggacgacugcgucgugaagccccuggacgagcgguucuccacgagccuccuguuccugaacgacaugggcaaggugcgcaaggacgucccccagugggacccguccaagggguggaagaacuggcaggaggugcccuucugcagccaccacuuccacaagaucuucaugaaggacggccggucccuggugguccccugccgcaaccaggacgagcucaucgggcgggcccgcaucagccagggcgccggcuggucccugcgggagaccgccugccuggggaaggcguacgcccagauguggagccucauguacuuccaccgccgcgaccugcggcuggccuccauggccaucugcagcgccgugcccaccgagugguucccgaccagccgcacgaccugguccauccacgcgcagcaccaguggaugaccaccgaggacaugcucaagguguggaaccgggucuggaucgaggacaaccccaacaugacggacaagacccccgugcacagcugggaggacauccccuaccugggcaagcgcgaggaccuguggugcgggucccucaucggccugagcucccgggccaccugggccaagaacauccacaccgccaucacccaggugcgcaaccugaucgggaaggaggaguacgucgacuacaugccggugaugaagcgguacagcgcccccuccgagagcgagggcgugcucuga

SEQ ID NO: 10499 - RNA, 9867 nt, Artificial Sequence
  derived and/or modified CDS sequence (opt1) from DENV-4__JQ915081__SS-prME
agcaccaugacccugcucugccugauccccaccgugauggccuuccaccugagcacccgcgacggcgagccgcucaugaucguggccaagcacgagcgggggcgcccccugcuguucaagaccaccgagggcaucaacaagugcacccucaucgcgauggaccugggggagaugugcgaggacaccgugaccuacaagugcccccugcucgugaacaccgagcccgaggacaucgacugcuggugcaaccugaccagcaccugggugauguacgggaccugcacccaguccggggagcggcgccgggagaagcgcagcguggcccugaccccgcacuccggcaugggccucgagacccgggccgagaccuggaugagcuccgagggggccuggaagcacgcccagcgcguggagagcuggauccugcggaaccccggcuucgcgcugcucgccggguucauggccuacaugaucggccagaccgggauccagcgcaucgucuucuucgugcugaugaugcugguggcccccuccuacggcaugcggugcgucggcguggggaaccgcgacuucguggagggcgucagcgggggcgcguggguggaccucgugcuggagcacggcgggugcgucacgaccauggcccagggcaagcccacccuggacuucgagcucaccaagacgaccgccaaggagguggcccugcugcggaccuacugcaucgaggccuccaucagcaacaucaccacggcgacccgcugcccgacccagggggagcccuaccucaaggaggagcaggaccagcaguacaucugccggcgcgacguggucgaccggggcugggggaacggcugcggccuguucgggaagggcgggguggugaccugcgccaaguuccugugcuccggcaagaucacggggaaccucguccagaucgagaaccuggaguacaccgugguggucaccgugcacaacggcgacacccacgccgucggcaacgacacgagcaaccacggggugaccgccaccaucacgccccggucccccagcguggaggucaagcugccggacuacggcgagcucacgcuggacugcgagccccgguccgggaucgacuucaacgagaugauccugaugaagaugaagaagaagaccuggcucgugcacaagcagugguuccuggaccugccccuccccuggaccgccggcgcggacaccagcgaggugcacuggaacuacaaggagcgcauggucaccuucaaggugccgcacgccaagcggcaggacgugacgguccuggggucccaggagggcgccaugcacagcgcccuggccggcgcgaccgagguggacagcggggacggcaaccacauguucgccgggcaccucaagugcaaggugcgcauggagaagcugcgcaucaagggcauguccuacaccaugugcagcggcaaguucuccaucgacaaggagauggccgagacccagcacgggacgaccgucgugaaggugaaguacgagggcgccggggcccccugcaagauccccaucgagauccgggacgucaacaaggagaagguggugggccgcaucaucagcuccacccccuucgcggagaacaccaacagcgucaucaacaucgagcuggagccgcccuucggggacuccuacaucgugaucggcgugggcgacagcgcccucacgcugcacugguuccggaagggguccagcaucggcaagauguucgaguccaccuaccgcggggccaagcggauggccauccugggcgagaccgcgugggacuucgggagcgucggcggccucuucaccucccuggggaaggccgugcaccagguguucggcagcgucuacacgaccauguucgggggcguguccuggaugauccgcauccugaucggguuccucgugcuguggaucggcaccaacagccggaacaccuccauggccaugacgugcaucgccgucggcgggaucacccuguuccugggcuucaccgugcaggccgacauggggugcguggucagcuggaacggcaaggagcucaagugcggguccggcaucuucgugguggacaacguccacaccuggacggagcaguacaaguuccagcccgagagccccgcgcgccuggccagcgccauccugaacgcccacaaggacggcgugugcgggauccgguccaccacccgccucgagaacgugauguggaagcagaucaccaacgagcugaacuacguccugugggagggcgggcacgaccucacggugguggccggcgacgucaagggcgugcugaccaaggggaagcgggcgcugaccccgcccgugaacgaccucaaguacagcuggaagaccuggggcaaggccaagaucuucacgcccgaggcccgcaacuccaccuuccugaucgacgggcccgacaccagcgagugcccgaacgagcggcgcgccuggaacuucuucgaggucgaggacuacggcuucgggauguucaccacgaacaucuggaugaaguuccgggagggcuccagcgaggugugcgaccaccgccugauguccgccgcgaucaaggaccagaaggccgugcacgccgacaugggcuacuggaucgagagcuccaagaaccagaccuggcagaucgagaaggccagccucaucgaggucaagaccugccuguggcccaagacccacacgcugugguccaacggggugcucgagagccagaugcugaucccccgguccuacgcgggcccguucagccagcacaacuaccgccagggguacgccacccagaccgccggccccuggcaccuggggaagcucgagaucgacuucggcgagugccccggcaccaccgugaagauccaggaggacugcgaccaccgggggcccucccugcgcacgaccaccgccagcggcaagcuggucacccaguggugcugccgcuccugcacgaugccgccccuccgguuccugggggaggacggcugcugguacgggauggagauccgcccccugagcgagaaggaggagaacauggucaagagccaggugaccgccggccagggcaccuccgagaccuucagcauggggcuccugugccugacccucuucgucgaggagugccugcggcgccgggugacccgcaagcacaugauccuggucguggugaucaccuucugcgcgaucauccucggcgggcugaccuggauggaccugcuccgggcccugaucaugcugggcgacacgauguccggccgcaucgggggccagauccaccucgccaucaugaccgucuucaagaugagccccggguacgugcugggcguguuccugcggaagcucaccucccgcgagaccgcccugauggucaucgggauggccaugacgaccguguucagcaucccgcacgaccugauggagcucaucgacggcaucucccugggccugauccuccugaagaucgugacccacuucgacaacacccaggucgggacgcuggcgcucagccugaccuucauccgguccaccacgccccuggugauggccuggcgcacgaucauggccguguucuucgucaucacccucaucccccugugccggaccagcugccugcagaagcagucccacuggguggagaucaccgcccucauccugggcgcccaggcgcugcccguguaccucaugacgcugaugaagggggccagccgccgguccuggccgcugaacgagggcaucauggccgucgggcucgugagccugcugggcuccgcccuccugaagaacgacgugccccuggcgggccccauggucgccgggggccuccugcuggccgccuacgugaugagcggguccagcgccgaccucucccuggagaaggcggccaacgugcagugggacgagauggccgacaucaccggcagcagccccaucaucgaggucaagcaggacgaggacggguccuucagcauccgcgacguggaggagaccaacaugaucacccugcucgugaagcuggcccugaucacggucuccggccucuacccgcuggccauccccgugaccauggcgcugugguacaucuggcaggucaagacccagcggagcggcgcccucugggacguccccucccccgccgccacccagaaggccacgcugagcgaggggguguaccgcaucaugcagcggggccuguucgggaagacccaggugggcgucgggauccacauggagggcguguuccacaccauguggcacgugacccgcggcuccgucaucugccacgagaccgggcggcucgagccgagcugggcggacgugcgcaacgacaugaucuccuacggcgggggcuggcgccugggcgacaagugggacaaggaggaggacgugcagguccuggccaucgagcccgggaagaacccccggcacgugcagacgaagcccggccucuucaagacccugaccggggagaucggcgccgugacccuggacuucaagccggggacgagcggcucccccaucaucaacaagaagggcaaggucaucgggcucuacggcaacgggguggugaccaagagcggcgacuacgucuccgccaucacccaggccgagcgcaucggggagcccgacuacgagguggacgaggacaucuuccggaagaagcgccugaccaucauggaccugcacccgggcgcgggcaagacgaagcggauccuccccagcaucgugcgcgaggcccugaagcggcgccugcggacccucauccuggcccccacccgcgucguggccgcggagauggaggaggcccugcgggggcugcccauccgcuaccagaccccggccgugaaguccgagcacacgggccgggagaucgucgaccucaugugccacgccaccuucaccacccgccugcugagcuccacgcgggugcccaacuacaaccucaucgugauggacgaggcccacuucaccgaccccugcagcgucgcggcccgcggguacaucuccacccggguggagaugggcgaggccgccgccaucuucaugaccgcgacgcccccggggagcaucgaccccuucccccagagcaacucccccaucgaggacaucgagcgcgagaucccggagcggagcuggaacaccggcuucgacuggaucaccgacuaccagggcaagaccgucugguucgugcccuccaucaaggccgggaacgacaucgccaacugccugcgcaagagcggcaagcgcgugauccagcugucccggaagacguucgacaccgaguaccccaagaccaagcucaccgacugggacuucgucgugacgaccgacaucagcgagaugggggccaacuuccgcgccggccgggugaucgacccccgccggugccugaagccggucauccugaccgacgggcccgagcgcgugauccucgcgggccccauccccgugaccccggccuccgccgcccagcggcgcggccggaucgggcgcaaccccgcgcaggaggacgaccaguacgucuucagcggcgacccccugaagaacgacgaggaccacgcccacuggacggaggccaagaugcugcucgacaacaucuacacccccgaggggaucaucccgacccuguucggccccgagcgggagaagacccaggccaucgacggcgaguuccgccugcgcggggagcagcgcaagacguucguggagcucaugcggcgcggcgaccugcccguguggcuguccuacaaggucgccagcgcggggaucuccuacaaggaccgggaguggugcuucaccggcgagcgcaacaaccagauccucgaggagaacauggagguggagaucuggacccgggagggggagaagaagaagcugcgccccaaguggcuggacgcccggguguacgccgacccgauggcccucaaggacuucaaggaguucgccagcggccgcaaguccaccacgcuggacauccugaccgagaucgcgacccuccccaccuaccugagcuccaaggccaagcuggcccucgacaacaucgucaugcugcacaccacggagaagggcgggcgcgccuaccagcacgcccugaacgagcuccccgagagccuggagacccugaugcucguggcgcugcugggcgccaugaccgccgggaucuuccucuucuucaugcagggcaaggggaucggcaagcuguccaugggccugaucgccaucgcgguggccagcgggcuccugugggucgccgagauccagccgcaguggaucgccgccuccaucauccuggaguucuuccucauggugcugcugauccccgagcccgagaagcagcggacgccccaggacaaccagcucaucuacgugauccugacgauccugaccaucaucggccucaucgcggccaacgagauggggcugaucgagaagaccaagaccgacuucggcuucuaccaggucaagacggagaccaccauccuggacguggaccuccgcccggccagcgccuggacccuguacgccguggcgacgaccauccugacccccaugcuccggcacaccaucgagaacaugagcgccaaccugucccuggccgccaucgccaaccaggcggccguccucauggggcugggcaagggcuggccccugcaccgcauggaccucggggugccccugcuggccaugggcugcuacagccaggugaacccgacgacccucaccgccucccuggucaugcugcucauccacuacgccaucaucgggcccggccugcaggcgaaggccacccgggaggcccagaagcgcacggccgcgggcaucaugaagaaccccaccguggacgggaucaccgugaucgaccuggagcccaucagcuacgacccgaaguucgagaagcagcucggccaggucaugcugcuggugcucugcguggggcagcugcugcucaugcggaccacgugggcccugugcgagguccugacccucgccaccggccccaucaucacccugugggaggggaaccccggccgcuucuggaacacgaccaucgccguguccaccgccaacaucuuccggggcagcuaccuggcgggggccggccucgccuucucccugaucaagaacgcccagacgccccgccgggggacgggcaccaccggggagacccugggcgagaaguggaagcgccagcucaacagccuggaccggaaggaguucgaggaguacaagcgcuccggcauccuggagguggaccggacggaggccaagagcgcgcuccgcgacggguccaagaucaagcacgccgucagccggggcuccagcaagauccgcuggaucguggagcgggggaugaucaagccgaagggcaagguggucgaccuggggugcggccgcggcgggugguccuacuacauggccacccugaagaacgugaccgaggugaagggcuacaccaagggcggccccgggcacgaggagcccauccccauggccaccuacggcuggaaccucgucaagcugcacagcggcguggacguguucuacaagccgacggagcaggucgacacccugcucugcgacaucggggaguccagcuccaaccccaccaucgaggagggccgcacccugcggauccugaagaugguggagcccuggcucagcagcaagcccgaguucugcaucaaggugcugaacccguacaugcccacggucaucgaggagcuggagaagcuccagcgccggcacgggggcucccuggugcgcugcccccugagccggaacuccacccacgagauguacugggugagcggcgccuccgggaacaucgucagcuccgugaacaccaucagcaagaugcugcucaaccgcuucaccacgcggcaccgcaagcccaccuacgagaaggacgucgaccugggcgcggggacccgguccgugagcaucgagaccgagaagccggacaugacgaucaucggccgccggcugcagcgccuccaggaggagcacaaggagaccuggcacuacgaccaggagaaccccuaccggaccugggccuaccacggguccuacgaggcccccagcaccggcuccgccagcuccauggugaacggcgucgugaagcugcugacgaagccgugggacgugauccccauggucacccagcucgcgaugaccgacaccacgcccuucgggcagcagcgcguguucaaggagaagguggacacccggacgccccagccgaagcugggcacccgcaugaucaugacgaccaccgccaacuggcugugggcccuccuggggaagaagaaguccccgcggcugugcacccgcgaggaguucaucuccaagguccggagcaacgccgccaucggcgcgguguuccaggaggagcagggguggacguccgccagcgaggccgugaacgacagccgcuucugggagcucgucgacaaggagcgggcccugcaccaggagggcaagugcgaguccugcguguacaacaugaugggcaagcgcgagaagaagcugggggaguucggccgcgccaaggggagccgggcgaucugguacauguggcucggcgcccgcuuccuggaguucgaggcccugggguuccucaacgaggaccacugguucucccgggagaacagcugguccggcguggagggcgaggggcugcaccgccugggcuacauccucgaggacaucgacaagaaggacggggaccugaucuacgccgacgacaccgccggcugggacacccggaucaccgaggacgaccugcucaacgaggagcugaucacggagcagauggcgccccaccacaagacccuggccaaggccaucuucaagcucaccuaccagaacaaggucgugaaggugcugcgccccacccccaagggcgccgucauggacaucaucagccggaaggaccagcgcggguccggccagguggggacguacggccugaacaccuucaccaacauggaggugcagcucauccggcagauggaggcggagggggucaucacccaggacgacaugcagaaccccaagggccugaaggagcgcguggagaaguggcugaaggagugcggcguggaccggcucaagcgcauggccaucagcggggacgacugcgucgugaagccccuggacgagcgguucuccaccagccuccuguuccugaacgacaugggcaaggugcgcaaggacgucccccagugggacccguccaagggguggaagaacuggcaggaggugcccuucugcagccaccacuuccacaagaucuucaugaaggacggccggucccuggugguccccugccgcaaccaggacgagcucaucgggcgggcccgcaucagccagggcgccggcuggucccugcgggagacggccugccuggggaaggcguacgcccagauguggagccucauguacuuccaccgccgcgaccugcggcuggccuccauggccaucugcagcgccgugcccaccgagugguucccgaccagccgcaccacgugguccauccacgcgcagcaccaguggaugaccaccgaggacaugcucaagguguggaaccgggucuggaucgaggacaaccccaacaugaccgacaagacgcccgugcacagcugggaggacauccccuaccugggcaagcgcgaggaccuguggugcgggucccucaucggccugagcucccgggccaccugggccaagaacauccacaccgccaucacccaggugcgcaaccugaucgggaaggaggaguacgucgacuacaugccggugaugaagcgguacagcgcccccuccgagagcgagggcgugcucuga

SEQ ID NO: 10500 - RNA, 9867 nt, Artificial Sequence
  derived and/or modified CDS sequence (opt1) from DENV-4__JQ915084__SS-prME
agcaccaugacccugcucugccugauccccaccgugauggccuuccaccugagcacccgcgacggcgagccgcucaugaucguggccaagcacgagcgggggcgcccccugcuguucaagaccaccgagggcaucaacaagugcacccucaucgcgauggaccugggggagaugugcgaggacaccgugaccuacaagugcccccugcucgugaacaccgagcccgaggacaucgacugcuggugcaaccugaccagcaccugggugauguacgggaccugcacccaguccggggagcggcgccgggagaagcgcagcguggcccugacgccgcacuccggcaugggccucgagacccgggccgagaccuggaugagcuccgagggggccuggaagcacgcccagcgcguggagagcuggauccugcggaaccccggcuucgcgcugcucgccggguucauggccuacaugaucggccagaccgggauccagcgcaucgucuucuucgugcugaugaugcugguggcccccuccuacggcaugcggugcgucggcguggggaaccgcgacuucguggagggcgucagcgggggcgcguggguggaccucgugcuggagcacggcgggugcgucacgaccauggcccagggcaagcccacccuggacuucgagcucaccaagacgaccgccaaggagguggcccugcugcggaccuacugcaucgaggccuccaucagcaacaucaccacggcgacccgcugcccgacccagggggagcccuaccucaaggaggagcaggaccagcaguacaucugccggcgcgacguggucgaccggggcugggggaacggcugcggccuguucgggaagggcgggguggugaccugcgccaaguuccugugcuccggcaagaucacggggaaccucguccagaucgagaaccuggaguacaccgugguggucaccgugcacaacggcgacacccacgccgucggcaacgacacgagcaaccacggggugaccgccaccaucacgccccggucccccagcguggaggucaagcugccggacuacggcgagcucacgcuggacugcgagccccgguccgggaucgacuucaacgagaugauccugaugaagaugaagaagaagaccuggcucgugcacaagcagugguuccuggaccugccccuccccuggaccgccggcgcggacaccagcgaggugcacuggaacuacaaggagcgcauggucaccuucaaggugccgcacgccaagcggcaggacgugacgguccuggggucccaggagggcgccaugcacagcgcccuggccggcgcgaccgagguggacagcggggacggcaaccacauguucgccgggcaccucaagugcaaggugcgcauggagaagcugcgcaucaagggcauguccuacaccaugugcagcggcaaguucuccaucgacaaggagauggccgagacccagcacgggacgaccgucgugaaggugaaguacgagggcgccggggcccccugcaagauccccaucgagauccgggacgucaacaaggagaagguggugggccgcaucaucagcuccacccccuucgcggagaacaccaacagcgucaucaacaucgagcuggagccgcccuucggggacuccuacaucgugaucggcgugggcgacagcgcccucacgcugcacugguuccggaagggguccagcaucggcaagauguucgaguccaccuaccgcggggccaagcggauggccauccugggcgagaccgcgugggacuucgggagcgucggcggccucuucaccucccuggggaaggccgugcaccagguguucggcagcgucuacacgaccauguucgggggcguguccuggaugauccgcauccugaucggguuccucgugcuguggaucggcaccaacagccggaacaccuccauggccaugacgugcaucgccgucggcgggaucacccuguuccugggcuucaccgugcaggccgacauggggugcguggucagcuggaacggcaaggagcucaagugcggguccggcaucuucgugguggacaacguccacaccuggacggagcaguacaaguuccagcccgagagccccgcgcgccuggccagcgccauccugaacgcccacaaggacggcgugugcgggauccgguccaccacccgccucgagaacgugauguggaagcagaucaccaacgagcugaacuacguccugugggagggcgggcacgaccucacggugguggccggcgacgucaagggcgugcugaccaaggggaagcgggcgcugaccccgcccgugaacgaccucaaguacagcuggaagaccuggggcaaggccaagaucuucacgcccgaggcccgcaacuccaccuuccugaucgacgggcccgacaccagcgagugcccgaacgagcggcgcgccuggaacuucuucgaggucgaggacuacggcuucgggauguucaccacgaacaucuggaugaaguuccgggagggcuccagcgaggugugcgaccaccgccugauguccgccgcgaucaaggaccagaaggccgugcacgccgacaugggcuacuggaucgagagcuccaagaaccagaccuggcagaucgagaaggccagccucaucgaggucaagaccugccuguggcccaagacccacacgcugugguccaacggggugcucgagagccagaugcugaucccccgguccuacgcgggcccguucagccagcacaacuaccgccagggguacgccacccagaccgccggccccuggcaccuggggaagcucgagaucgacuucggcgagugccccggcaccaccgugaagauccaggaggacugcgaccaccgggggcccucccugcgcacgaccaccgccagcggcaagcuggucacccaguggugcugccgcuccugcacgaugccgccccuccgguuccugggggaggacggcugcugguacgggauggagauccgcccccugagcgagaaggaggagaacauggucaagagccaggugaccgccggccagggcaccuccgagaccuucagcauggggcuccugugccugacccucuucgucgaggagugccugcggcgccgggugacccgcaagcacaugauccuggucguggugaucaccuucugcgcgaucauccucggcgggcugaccuggauggaccugcuccgggcccugaucaugcugggcgacacgauguccggccgcaucgggggccagauccaccucgccaucaugaccgucuucaagaugagccccggguacgugcugggcguguuccugcggaagcucaccucccgcgagaccgcccugauggucaucgggauggccaugacgaccguguucagcaucccgcacgaccugauggagcucaucgacggcaucucccugggccugauccuccugaagaucgugacccacuucgacaacacccaggucgggacgcuggcgcucagccugaccuucaugcgguccaccacgccccuggugauggccuggcgcacgaucauggccguguucuucgucaucacccucaucccccugugccggaccagcugccugcagaagcagucccacuggguggagaucaccgcccucauccugggcgcccaggcgcugcccguguaccucaugacgcugaugaagggggccagccgccgguccuggccgcugaacgagggcaucauggccgucgggcucgugagccugcugggcuccgcccuccugaagaacgacgugccccuggcgggccccauggucgccgggggccuccugcuggccgccuacgugaugagcggguccagcgccgaccucucccuggagaaggcggccaacgugcagugggacgagauggccgacaucaccggcagcagccccaucaucgaggucaagcaggacgaggacggguccuucagcauccgcgacguggaggagaccaacaugaucacccugcucgugaagcuggcccugaucacggucuccggccucuacccgcuggccauccccgugaccauggcgcugugguacaucuggcaggucaagacccagcggagcggcgcccucugggacguccccucccccgccgccacccagaaggccacgcugagcgaggggguguaccgcaucaugcagcggggccuguucgggaagacccaggugggcgucgggauccacauggagggcguguuccacaccauguggcacgugacccgcggcuccgucaucugccacgagaccgggcggcucgagccgagcugggcggacgugcgcaacgacaugaucuccuacggcgggggcuggcgccugggcgacaagugggacaaggaggaggacgugcagguccuggccaucgagcccgggaagaacccccggcacgugcagacgaagcccggccucuucaagacccugaccggggagaucggcgccgugacccuggacuucaagccggggacgagcggcucccccaucaucaacaagaagggcaaggucaucgggcucuacggcaacgggguggugaccaagagcggcgacuacgucuccgccaucacccaggccgagcgcaucggggagcccgacuacgagguggacgaggacaucuuccggaagaagcgccugaccaucauggaccugcacccgggcgcgggcaagacgaagcggauccuccccagcaucgugcgcgaggcccugaagcggcgccugcggacccucauccuggcccccacccgcgucguggccgcggagauggaggaggcccugcgggggcugcccauccgcuaccagaccccggccgugaaguccgagcacacgggccgggagaucgucgaccucaugugccacgccaccuucaccacccgccugcugagcuccacgcgggugcccaacuacaaccucaucgugauggacgaggcccacuucaccgaccccugcagcgucgcggcccgcggguacaucuccacccggguggagaugggcgaggccgccgccaucuucaugaccgcgacgcccccggggagcaucgaccccuucccccagagcaacucccccaucgaggacaucgagcgcgagaucccggagcggagcuggaacaccggcuucgacuggaucaccgacuaccagggcaagaccgucugguucgugcccuccaucaaggccgggaacgacaucgccaacugccugcgcaagagcggcaagcgcgugauccagcugucccggaagacguucgacaccgaguaccccaagaccaagcucaccgacugggacuucgucgugacgaccgacaucagcgagaugggggccaacuuccgcgccggccgggugaucgacccccgccggugccugaagccggucauccugaccgacgggcccgagcgcgugauccucgcgggccccauccccgugaccccggccuccgccgcccagcggcgcggccggaucgggcgcaaccccgcgcaggaggacgaccaguacgucuucagcggcgacccccugaagaacgacgaggaccacgcccacuggacggaggccaagaugcugcucgacaacaucuacacccccgaggggaucaucccgacccuguucggccccgagcgggagaagacccaggccaucgacggcgaguuccgccugcgcggggagcagcgcaagacguucguggagcucaugcggcgcggcgaccugcccguguggcuguccuacaaggucgccagcgcggggaucuccuacaaggaccgggaguggugcuucaccggcgagcgcaacaaccagauccucgaggagaacauggagguggagaucuggacccgggagggggagaagaagaagcugcgccccaaguggcuggacgcccggguguacgccgacccgauggcccucaaggacuucaaggaguucgccagcggccgcaaguccaccacgcuggacauccugaccgagaucgcgacccuccccaccuaccugagcuccaaggccaagcuggcccucgacaacaucgucaugcugcacaccacggagaagggcgggcgcgccuaccagcacgcccugaacgagcuccccgagagccuggagacccugaugcucguggcgcugcugggcgccaugaccgccgggaucuuccucuucuucaugcagggcaaggggaucggcaagcuguccaugggccugaucgccaucgcgguggccagcgggcuccugugggucgccgagauccagccgcaguggaucgccgccuccaucauccuggaguucuuccucauggugcugcugauccccgagcccgagaagcagcggacgccccaggacaaccagcucaucuacgugauccugacgauccuggcgaucaucggccucaucgccgccaacgagauggggcugaucgagaagaccaagaccgacuucggcuucuaccaggucaagaccgagacgaccauccuggacguggaccuccgcccggccagcgccuggacccuguacgcgguggccaccacgauccugacccccaugcuccggcacaccaucgagaacaccagcgccaaccugucccuggccgccaucgcgaaccaggccgccguccucauggggcugggcaagggcuggccccugcaccgcauggaccucggggugccccugcuggccaugggcugcuacagccaggugaacccgacgacccucaccgccucccuggucaugcugcucauccacuacgcgaucaucgggcccggccugcaggccaaggccacccgggaggcccagaagcgcacggcggccggcaucaugaagaaccccaccguggacgggaucaccgugaucgaccuggagcccaucagcuacgacccgaaguucgagaagcagcucggccaggucaugcugcuggugcucugcguggggcagcugcugcucaugcggaccacgugggcccugugcgagguccugacccucgccaccggccccaucaugacccugugggaggggaaccccggccgcuucuggaacacgaccaucgccguguccaccgcgaacaucuuccggggcagcuaccuggccggggccggccucgccuucucccugaucaagaacgcccagacgccccgccgggggacgggcaccaccggggagacccugggcgagaaguggaagcgccagcucaacagccuggaccggaaggaguucgaggaguacaagcgcuccggcauccuggagguggaccggacggaggccaagagcgcccuccgcgacggguccaagaucaagcacgccgucagccggggcuccagcaagauccgcuggaucguggagcgggggaugaucaagccgaagggcaagguggucgaccuggggugcggccgcggcgggugguccuacuacauggccacccugaagaacgugaccgaggugaagggcuacaccaagggcggccccgggcacgaggagcccauccccauggccaccuacggcuggaaccucgucaagcugcacagcggcguggacguguucuacaagccgacggagcaggucgacacccugcucugcgacaucggggaguccagcuccaaccccaccaucgaggagggccgcacccugcggauccugaagaugguggagcccuggcucagcagcaagcccgaguucugcaucaaggugcugaacccguacaugcccacggucaucgaggagcuggagaagcuccagcgccggcacgggggcucccuggugcgcugcccccugagccggaacuccacccacgagauguacugggugagcggcgcguccgggaacaucgucagcuccgugaacaccaucagcaagaugcugcucaaccgcuucaccacgcggcaccgcaagcccaccuacgagaaggacgucgaccugggcgccgggacccgguccgugagcaccgagacggagaagccggacaugaccaucaucggccgccggcugcagcgccuccaggaggagcacaaggagaccuggcacuacgaccaggagaaccccuaccggaccugggccuaccacggguccuacgaggcccccagcacgggcuccgcgagcuccauggugaacggcgucgugaagcugcugaccaagccgugggacgugauccccauggucacccagcucgccaugaccgacacgacccccuucgggcagcagcgcguguucaaggagaagguggacacccggacgccccagccgaagaucggcacgcgcaugaucaugaccaccaccgccaacuggcugugggcccugcucgggaagaagaaguccccgcggcugugcacgcgcgaggaguucaucuccaagguccggagcaacgccgcgaucggcgccguguuccaggaggagcagggguggaccuccgccagcgaggccgugaacgacagccgcuucugggagcuggucgacaaggagcgggcccuccaccaggagggcaagugcgaguccugcguguacaacaugaugggcaagcgcgagaagaagcugggggaguucggccgcgcgaaggggagccgggccaucugguacauguggcugggcgcccgcuuccucgaguucgaggcccugggguuccugaacgaggaccacugguucucccgggagaacagcugguccggcguggagggcgaggggcuccaccgccugggcuacauccuggaggacaucgacaagaaggacggggaccucaucuacgccgacgacaccgcgggcugggacacccggaucacggaggacgaccugcugaacgaggagcucaucaccgagcagauggcgccccaccacaagacccuggccaaggccaucuucaagcugaccuaccagaacaaggucgugaaggugcuccgccccacgcccaagggcgcggucauggacaucaucagccggaaggaccagcgcggguccggccagguggggaccuacggccugaacaccuucaccaacauggaggugcagcugauccggcagauggaggccgagggggucaucacccaggacgacaugcagaaccccaagggccucaaggagcgcguggagaaguggcugaaggagugcggcguggaccggcugaagcgcauggccaucagcggggacgacugcgucgugaagccccucgacgagcgguucuccacgagccugcuguuccucaacgacaugggcaaggugcgcaaggacgucccccagugggagccguccaagggguggaagaacuggcaggaggugcccuucugcagccaccacuuccacaagaucuucaugaaggacggccggucccuggugguccccugccgcaaccaggacgagcugaucgggcgggcccgcaucagccagggcgccggcuggucccuccgggagaccgcgugccuggggaaggccuacgcccagauguggagccugauguacuuccaccgccgcgaccuccggcuggccuccauggccaucugcagcgcggugcccaccgagugguucccgaccagccgcacgaccugguccauccacgcccagcaccaguggaugaccaccgaggacaugcugaagguguggaaccgggucuggaucgaggacaaccccaacaugacggacaagacccccgugcacagcugggaggacauccccuaccucggcaagcgcgaggaccuguggugcgggucccugaucggccucagcucccgggccaccugggccaagaacauccacaccgccaucacccaggugcgcaaccugaucgggaaggaggaguacgucgacuacaugccggugaugaagcgguacagcucccccagcgaguccgagggcgugcuguga

SEQ ID NO: 10501 - RNA, 9867 nt, Artificial Sequence
  derived and/or modified CDS sequence (opt1) from DENV-4__KM190936__SS-prME
agcaccaucacccugcucugccugauccccaccgugauggccuucucccugagcacccgcgacggcgagccgcucaugaucguggccaagcacgagcgggggcgcccccugcuguucaagaccaccgagggcaucaacaagugcacccucaucgcgauggaccugggggagaugugcgaggacaccgugaccuacaagugcccccugcucgugaacaccgagcccgaggacaucgacugcuggugcaaccugaccuccaccugggugauguacgggaccugcacccagagcggggagcggcgccgggagaagcgcuccguggcccugaccccgcacagcggcaugggccucgagacccgggccgagaccuggauguccagcgagggggccuggaagcacgcccagcgcguggaguccuggauccugcggaaccccggcuucgcgcugcucgccggguucauggccuacaugaucggccagaccgggauccagcgcacgguguucuucgugcugaugaugcugguggcccccagcuacggcaugcggugcgugggcguggggaaccgcgacuucguggagggcgucuccgggggcgcguggguggaccucgugcuggagcacggcgggugcgucaccaccauggcccagggcaagcccacccuggacuucgagcucacgaagaccaccgccaaggagguggcccugcugcggaccuacugcaucgaggccagcaucuccaacaucacgaccgcgacccgcugcccgacccagggggagcccuaccucaaggaggagcaggaccagcaguacaucugccggcgcgacguggucgaccggggcugggggaacggcugcggccuguucgggaagggcgggguggugacgugcgccaaguucagcugcuccggcaagaucaccgggaaccugguccagaucgagaaccucgaguacaccgugguggucaccgugcacaacggcgacacgcacgccgucggcaacgacaccagcaaccacggggugaccgccaugaucacgccccggucccccagcguggaggucaagcugccggacuacggcgagcugacgcucgacugcgagccccgguccgggaucgacuucaacgagaugauccugaugaagaugaagaagaagaccuggcuggugcacaagcagugguuccucgaccugccccugcccuggaccgccggcgcggacaccagcgaggugcacuggaacuacaaggagcgcauggucaccuucaaggugccgcacgccaagcggcaggacgugacgguccucgggagccaggagggcgccaugcacuccgcccuggccggcgcgaccgagguggacagcggggacggcaaccacauguucgccgggcaccugaagugcaaggugcgcauggagaagcuccgcaucaagggcauguccuacaccaugugcagcggcaaguucuccaucgacaaggagauggccgagacccagcacgggacgaccgucgugaaggugaaguacgagggcgccggggcccccugcaagguccccaucgagauccgggacgugaacaaggagaagguggucggccgcaucaucagcuccacgccccuggcggagaacaccaacagcgugacgaacaucgagcuggagccgcccuucggggacuccuacaucgugaucggcgucggcaacagcgcccucacccugcacugguuccggaagggguccagcaucggcaagauguucgaguccaccuaccgcggggccaagcggauggccauccugggcgagaccgcgugggacuucgggagcgugggcggccucuucacgucccuggggaaggccgugcaccaggucuucggcagcguguacaccaccauguucgggggcguguccuggaugauccgcauccugaucggguuccucguccuguggaucggcaccaacagccggaacacguccauggccaugaccugcaucgccgugggcgggaucacccuguuccugggcuucaccgugcaggccgacauggggugcgucgugagcuggagcggcaaggagcucaagugcggguccggcaucuucguggucgacaacgugcacacguggaccgagcaguacaaguuccagcccgagagccccgcgcgccuggccuccgccauccugaacgcccacaaggacggcgugugcgggauccggagcaccacccgccucgagaacgucauguggaagcagaucacgaacgagcugaacuacgugcugugggagggcgggcacgaccucaccguggucgccggcgacgugaagggcgugcugaccaaggggaagcgggcgcugaccccgcccgucuccgaccucaaguacagcuggaagacguggggcaaggccaagaucuucacccccgaggcccgcaacuccaccuuccugaucgacgggcccgacaccagcgagugcccgaacgagcggcgcgccuggaacucccuggagguggaggacuacggcuucgggauguucacgaccaacaucuggaugaaguuccgggagggcagcuccgaggugugcgaccaccgccucaugagcgccgcgaucaaggaccagaaggccguccacgccgacaugggcuacuggaucgaguccagcaagaaccagaccuggcagaucgagaaggccucccugaucgaggugaagaccugccuguggcccaagacgcacacccucuggagcaacggggugcuggagucccagaugcugauccccaagagcuacgcgggcccguucagccagcacaacuaccggcagggguacgccacccagaccgucggccccuggcaccucgggaagcuggagaucgacuucggcgagugccccggcaccacggugaccauccaggaggacugcgaccaccgcgggcccucccugcggaccaccacggccagcggcaagcucgugacccaguggugcugccgcuccugcaccaugccgccccugcgcuuccugggggaggacggcugcugguacgggauggagauccggccccucagcgagaaggaggagaacauggucaagucccaggugaccgccggccagggcacgagcgagaccuucuccauggggcugcugugccucacccuguucgucgaggagugccugcgccggcgcgugacccggaagcacaugauccucguggucgugaucacgcugugcgccaucauccugggcgggcucaccuggauggaccugcugcgcgcgcucaucaugcugggcgacaccaugagcggccggaucgggggccagauccaccuggccaucauggccguguucaagaugucccccggguacguccucggcguguuccugcgcaagcugaccagccgggagacggcccucauggugaucgggauggccaugaccaccguccuguccaucccgcacgaccugauggagcucaucgacggcaucagccugggccugauccuccugaagaucgugacccaguucgacaacacccagguggggacccuggcgcucucccugaccuucauccgcagcaccaugccccuggucauggccuggcggacgaucauggccguccucuucguggucacccugaucccccugugccgcaccuccugccuccagaagcagagccacuggguggagaucaccgcccugauccugggcgcccaggcgcuccccguguaccugaugacgcugaugaagggggccucccggcgcagcuggccgcucaacgagggcaucauggccgucgggcuggugucccugcucggcagcgcccugcugaagaacgacgugccccucgcgggccccauggucgccgggggccugcugcucgccgccuacgugaugagcggguccagcgccgaccugucccuggagaaggcggccaacgugcagugggacgagauggccgacaucaccggcagcucccccaucaucgaggucaagcaggacgaggacgggagcuucuccauccgggacguggaggagaccaacaugaucacccuccuggugaagcuggcccucaucacggucagcggccuguacccgcuggccauccccgugaccaugacccucugguacauguggcaggucaagacccagcgcuccggcgcgcugugggacguccccagccccgccgccacgcagaaggccgcccuguccgaggggguguaccggaucaugcagcgcggccucuucgggaagacccaggugggcgucgggauccacauggagggcguguuccacaccauguggcacgugacccggggcagcgucaucugccacgagaccgggcgccuggagccguccugggcggacgugcggaacgacaugaucagcuacggcgggggcuggcgccugggcgacaagugggacaaggaggaggacgugcagguccucgccaucgagcccgggaagaaccccaagcacgugcagacgaagcccggccuguucaagacccugaccggggagaucggcgccgugacccucgacuucaagccggggacguccggcagccccaucaucaaccgcaagggcaaggucaucgggcuguacggcaacgggguggugaccaaguccggcgacuacgucagcgccaucacccaggccgagcggaucggggagcccgacuacgagguggacgaggacaucuuccgcaagaagcggcugaccaucauggaccuccacccgggcgcgggcaagacgaagcgcauccugcccuccaucgugcgggaggcccugaagcgccggcugcgcacccucauccuggcccccacccgggucguggccgcggagauggaggaggcccugcgcgggcuccccauccgguaccagaccccggccgucaagagcgagcacacgggccgcgagaucgucgaccugaugugccacgccaccuucaccacccggcugcucagcuccacgcgcgugcccaacuacaaccugaucgucauggacgaggcccacuucaccgaccccagcuccguggcggcccggggguacaucagcacccgcguggagaugggcgaggccgccgccaucuucaugaccgcgacgcccccgggggccaccgaccccuucccccaguccaacagccccaucgaggacaucgagcgggagaucccggagcgcuccuggaacaccggcuucgacuggaucaccgacuaccagggcaagacggucugguucgugcccagcaucaaggccgggaacgacaucgccaacugccugcggaaguccggcaagaaggugauccagcucagccgcaagaccuucgacaccgaguaccccaagaccaagcugacggacugggacuucgucgugaccaccgacaucuccgagaugggggccaacuuccgcgcgggccgggugaucgacccccgccggugccugaagccggucauccucaccgacgggcccgagcgcgugauccuggccggccccauccccgugacgccggccagcgccgcgcagcggcgcggccggaucgggcgcaaccccgcccaggaggacgaccaguacgucuucuccggcgacccccugaagaacgacgaggaccacgcccacuggaccgaggccaagaugcuccuggacaacaucuacacccccgaggggaucaucccgacccuguucggccccgagcgggagaagacgcaggccaucgacggcgaguuccgccuccgcggggagcagcgcaagaccuucguggagcugaugcggcgcggcgaccugcccguguggcucagcuacaaggucgcguccgccgggaucagcuacaaggaccgggaguggugcuucaccggcgagcgcaacaaccagauccuggaggagaacauggagguggagaucuggacccgggagggggagaagaagaagcugcgcccccgguggcucgacgcccgcguguacgccgacccgauggcccugaaggacuucaaggaguucgcguccggccgcaagagcaucacgcuggacauccucaccgagaucgccucccugcccaccuaccugagcagccgcgccaagcucgcccuggacaacaucgucaugcugcacaccaccgagcgcggcgggcgggccuaccagcacgcgcucaacgagcugcccgagucccuggagacgcucaugcugguggcccugcucggcgccaugaccgccgggaucuuccuguucuucaugcagggcaaggggaucggcaagcugagcaugggccucaucaccaucgcgguggccuccgggcugcugugggucgccgagauccagccgcaguggaucgccgccagcaucauccucgaguucuuccugauggugcugcucauccccgagcccgagaagcagcgcacgccccaggacaaccagcugaucuacgugauccugacgauccucaccaucaucggccugaucgcggccaacgagauggggcugaucgagaagaccaagaccgacuucggcuucuaccaggucaagacggagaccaccauccucgacguggaccugcggccggccuccgccuggacccuguacgccguggcgacgaccauccucacccccaugcugcgccacaccaucgagaacacgagcgccaaccugucccucgccgccaucgccaaccaggcggccguccugauggggcugggcaagggcuggccccuccaccggauggaccugggggugccccugcucgccaugggcugcuacagccaggugaacccgaccacccugaccgccucccuggucaugcuccuggugcacuacgccaucaucgggcccggccugcaggcgaaggccacgcgcgaggcccagaagcggaccgccgcgggcaucaugaagaaccccaccguggacgggaucaccgucaucgaccucgagcccaucagcuacgacccgaaguucgagaagcagcugggccaggugaugcugcucgugcugugcgccgggcagcugcuccugaugcgcacgaccugggccuucugcgagguccugacccucgccaccggccccauccugacgcugugggaggggaaccccggccgguucuggaacaccaccaucgccguguccaccgcgaacaucuuccgcggcagcuaccucgccggggccggccuggccuucucccugaucaagaacgcccagacgccccggcgcgggaccggcaccaccggggagacgcucggcgagaaguggaagcggcagcugaacagccuggaccgcaaggaguucgaggaguacaagcgguccggcauccucgagguggaccgcaccgaggccaagagcgcccugaaggacggguccaagaucaagcacgccgucagccggggcuccagcaagauccgcuggaucguggagcgggggauggugaagccgaagggcaaggucguggaccuggggugcggccgcggcggguggagcuacuacauggccacccucaagaacgugaccgaggucaagggcuacaccaagggcgggcccgggcacgaggagcccauccccauggccacguacggcuggaaccuggugaagcugcacuccggcguggacgucuucuacaagccgaccgagcaggucgacacccuccugugcgacaucggggagagcuccagcaaccccaccaucgaggagggccgcacgcugcgggugcucaagauggucgagcccuggcuguccagcaagcccgaguucugcaucaaggugcugaacccguacaugcccaccgucaucgaggagcuggagaagcuccagcgcaagcacgggggcaaccuggugcggugcccccugucccgcaacagcacccacgagauguacuggguguccggcgcgagcgggaacaucgucuccagcgugaacaccacguccaagaugcuccugaaccgguucaccacccgccaccggaagcccaccuacgagaaggacguggaccugggcgccgggacgcgcagcgucuccaccgagaccgagaagccggacaugaccaucaucggccggcgccuccagcggcugcaggaggagcacaaggagacguggcacuacgaccaggagaaccccuaccgcaccugggccuaccacgggagcuacgaggcccccuccaccggcagcgcguccagcauggugaacggcguggucaagcugcucaccaagccgugggacgugauccccauggugacgcagcuggccaugaccgacaccacccccuucgggcagcagcgggucuucaaggagaagguggacacgcgcacgccccagccgaagcccggcacccggauggugaugaccacgaccgccaacuggcugugggcccuccuggggaagaagaagaacccccgccugugcacccgggaggaguucaucagcaagguccgcuccaacgccgcgaucggcgccguguuccaggaggagcagggguggaccagcgccuccgaggccgugaacgacagccgguucugggagcucgucgacaaggagcgcgcccugcaccaggagggcaagugcgaguccugcguguacaacaugaugggcaagcgggagaagaagcugggggaguucggccgcgcgaaggggagccgcgccaucugguacauguggcucggcgcccgguuccuggaguucgaggcccugggguuccucaacgaggaccacugguucggccgcgagaacuccuggagcggcguggagggggagggccugcaccggcugggguacauccucgaggagaucgacaagaaggacggcgaccugauguacgccgacgacacggcgggcugggacacccgcaucaccgaggacgaccugcagaacgaggagcucaucaccgagcagauggcgccccaccacaagauccuggccaaggccaucuucaagcugacguaccagaacaaggucgugaaggugcuccggccgacgccccgcggggcggucauggacaucaucucccggaaggaccagcggggcagcggccaggugggcaccuacgggcugaacaccuucaccaacauggaggugcagcugauccggcagauggaggccgagggcgucaucacgcaggacgacaugcagaaccccaagggccucaaggagcgcguggagaaguggcugaaggagugcgggguggaccggcugaagcgcauggccaucuccggcgacgacugcgucgugaagccccucgacgagcgguucgggaccagccugcuguuccucaacgacaugggcaaggugcgcaaggacaucccgcagugggagcccuccaagggguggaagaacuggcaggagguccccuucugcagccaccacuuccacaagaucuucaugaaggacggccggucccugguggugcccugccgcaaccaggacgagcugaucggccgggcccgcaucagccagggggccggcuggucccuccgggagaccgcgugccuggggaaggccuacgcccagauguggagccugauguacuuccaccgccgcgaccuccggcuggccagcauggccaucugcuccgcggucccgaccgagugguuccccacgagccgcaccaccugguccauccacgcccaccaccaguggaugaccacggaggacaugcugaagguguggaaccggguguggaucgaggacaaccccaacaugaccgacaagacccccguccacagcugggaggacaucccguaccucggcaagcgcgaggaccuguggugcgggucccugaucggccucagcucccgggccaccugggccaagaacauccacacggccaucacccaggugcgcaaccugaucggcaaggaggaguacguggacuacaugcccgucaugaagcgguacagcgcgcccuccgagagcgagggggugcuguga

SEQ ID NO: 10502 - RNA, 9867 nt, Artificial Sequence
  derived and/or modified CDS sequence (opt1) from DENV-4__JQ915090__SS-prME
agcaccaugacccugcucugccugauccccaccgugauggccuuccaccuguccacccgcgacggcgagccgcucaugaucguggccaagcacgagcgggggcgcccccugcuguucaagaccaccgagggcaucaacaagugcacccucaucgccauggaccugggggagaugugcgaggacaccgugaccuacaagugcccccugcucgugaacaccgagcccgaggacaucgacugcuggugcaaccugaccagcaccugggugauguacgggaccugcacccaguccggggagcggcgccgggagaagcgcagcguggcccugaccccgcacuccggcaugggccucgagacccgggccgagaccuggaugagcuccgagggggccuggaagcacgcccagcgcguggagagcuggauccugcggaaccccggcuucgcgcugcucgccggguucauggccuacaugaucggccagaccgggauccagcgcaucgucuucuucgugcugaugaugcugguggcccccuccuacggcaugcggugcgucggcguggggaaccgcgacuucguggagggcgucagcgggggcgcguggguggaccucgugcuggagcacggcgggugcgucaccaccauggcccagggcaagcccacccuggacuucgagcucgccaagaccacggccaaggagguggcccugcugcggaccuacugcaucgaggcguccaucagcaacaucaccaccgccacgcgcugcccgacccagggggagcccuaccucaaggaggagcaggaccagcaguacaucugccggcgcgacguggucgaccggggcugggggaacggcugcggccuguucgggaagggcgggguggugaccugcgccaaguuccugugcuccggcaagaucaccgggaaccucguccagaucgagaaccuggaguacacggugguggucaccgugcacaacggcgacacccacgccgucggcaacgacaccagcaaccacggggugacggccaccaucacgccccggucccccagcguggaggucaagcugccggacuacggcgagcucacccuggacugcgagccccgguccgggaucgacuucaacgagaugauccugaugaagaugaagaagaagacguggcucgugcacaagcagugguuccuggaccugccccuccccuggaccgcgggcgccgacaccagcgaggugcacuggaacuacaaggagcgcauggucaccuucaaggugccgcacgccaagcggcaggacgugaccguccuggggucccaggagggcgccaugcacagcgcccuggcgggcgccacggagguggacagcggggacggcaaccacauguucgccgggcaccucaagugcaaggugcgcauggagaagcugcgcaucaagggcauguccuacaccaugugcagcggcaaguucuccaucgacaaggagauggccgagacccagcacgggaccacggucgugaaggugaaguacgagggcgccggggcgcccugcaagauccccaucgagauccgggacgucaacaaggagaagguggugggccgcaucaucagcuccacccccuucgccgagaacaccaacagcgucaucaacaucgagcuggagccgcccuucggggacuccuacaucgugaucggcgugggcgacagcgcccucacccugcacugguuccggaagggguccagcaucggcaagauguucgaguccacguaccgcggggccaagcggauggcgauccugggcgagaccgccugggacuucgggagcgucggcggccucuucaccucccuggggaaggccgugcaccagguguucggcagcgucuacaccacgauguucgggggcguguccuggaugauccgcauccugaucggguuccucgugcuguggaucggcaccaacagccggaacaccuccauggccaugaccugcaucgccgucggcgggaucacgcuguuccugggcuucaccgugcaggcggacauggggugcguggucagcuggaacggcaaggagcucaagugcggguccggcaucuucgugguggacaacguccacaccuggaccgagcaguacaaguuccagcccgagagccccgcccgccuggccagcgccauccugaacgcccacaaggacggcgugugcgggauccgguccacgacccgccucgagaacgugauguggaagcagaucaccaacgagcugaacuacguccugugggagggcgggcacgaccucaccgugguggcgggcgacgucaagggcgugcugacgaaggggaagcgggcccugaccccgcccgugaacgaccucaaguacagcuggaagaccuggggcaaggccaagaucuucacccccgaggcccgcaacuccacguuccugaucgacgggcccgacaccagcgagugcccgaacgagcggcgcgccuggaacuucuucgaggucgaggacuacggcuucgggauguucaccaccaacaucuggaugaaguuccgggagggcuccagcgaggugugcgaccaccgccugauguccgcggccaucaaggaccagaaggccgugcacgccgacaugggcuacuggaucgagagcuccaagaaccagacguggcagaucgagaaggcgagccucaucgaggucaagaccugccuguggcccaagacccacacccugugguccaacggggugcucgagagccagaugcugaucccccgguccuacgccggcccguucagccagcacaacuaccgccagggguacgccacgcagaccgccggccccuggcaccuggggaagcucgagaucgacuucggcgagugccccggcaccaccgugaagauccaggaggacugcgaccaccgggggcccucccugcgcaccacgaccgccagcggcaagcuggucacccaguggugcugccgcuccugcaccaugccgccccuccgguuccugggggaggacggcugcugguacgggauggagauccgcccccugagcgagaaggaggagaacauggugaagucccaggugacggcgggccagggcaccuccgagaccuucagcauggggcuccugugccugacccucuucgucgaggagugccugcggcgccgggugacgcgcaagcacaugauccuggucguggugaucaccuucugcgccaucauccucggcgggcugaccuggauggaccugcuccgggcccugaucaugcugggcgacaccauguccggccgcaucgggggccagauccaccucgccaucaugacggucuucaagaugagccccggguacgugcugggcguguuccugcggaagcucaccucccgcgagaccgcccugauggucaucgggauggcgaugaccacgguguucagcaucccgcacgaccugauggagcucaucgacggcaucucccugggccugauccuccugaagaucgugacccacuucgacaacacccaggucgggacccuggcccucagccugacguucaugcgguccaccacgccccuggugauggccuggcgcaccaucauggccguguucuucgucaucacgcucaucccccugugccggaccagcugccugcagaagcagucccacuggguggagaugaccgcccucauccugggcgcgcaggcccugcccguguaccucaugacccugaugaagggggccagccgccgguccuggccgcugaacgagggcaucauggccgucgggcucgugagccugcugggcuccgcgcuccugaagaacgacgugccccuggccggccccauggucgccgggggccuccugcuggccgccuacgugaugagcggguccagcgcggaccucucccuggagaaggccgccaacgugcagugggacgagauggccgacaucacgggcagcagccccaucaucgaggucaagcaggacgaggacggguccuucagcauccgcgacguggaggagaccaacaugaucacccugcucgugaagcuggcccugaucaccgucuccggccucuacccgcuggcgauccccgugacgauggcccugugguacaucuggcaggucaagacccagcggagcggcgcccucugggacguccccucccccgccgccacccagaaggcgacccugagcgaggggguguaccgcaucaugcagcggggccuguucgggaagacccaggugggcgucgggauccacauggagggcguguuccacaccauguggcacgugacccgcggcuccgucaucugccacgagaccgggcggcucgagccgagcugggccgacgugcgcuccgacaugaucagcuacggcgggggcuggcgccugggcgacaagugggacaaggaggaggacgugcagguccuggccaucgagcccgggaagaacccccggcacgugcagaccaagcccggccucuucaagacgcugaccggggagaucggcgccgugacccuggacuucaagccggggaccuccggcagccccaucaucaacaagaagggcaaggucaucgggcucuacggcaacgggguggugacgaaguccggcgacuacgucagcgccaucacccaggcggagcgcaucggggagcccgacuacgagguggacgaggacaucuuccggaagaagcgccugaccaucauggaccugcacccgggcgccggcaagaccaagcggauccuccccuccaucgugcgcgaggcccugaagcggcgccugcggacgcucauccuggcccccacccgcgucguggcggccgagauggaggaggcccugcgggggcugcccauccgcuaccagaccccggccgucaagagcgagcacaccggccgggagaucgucgaccucaugugccacgccacguucaccacccgccugcuguccagcacccgggugcccaacuacaaccucaucgugauggacgaggcgcacuucacggaccccugcuccgucgccgcccgcggguacaucagcacccggguggagaugggcgaggccgccgcgaucuucaugaccgccacgcccccggggagcaucgaccccuucccccaguccaacagccccaucgaggacaucgagcgcgagaucccggagcgguccuggaacacgggcuucgacuggaucaccgacuaccagggcaagaccgucugguucgugcccagcaucaaggccgggaacgacaucgccaacugccugcgcaaguccggcaagcgcgugauccagcugagccggaagaccuucgacacggaguaccccaagaccaagcucaccgacugggacuucgucgugaccacggacaucuccgagaugggggccaacuuccgcgcgggccgggugaucgacccccgccggugccugaagccggucauccugaccgacgggcccgagcgcgugauccucgccggccccauccccgugaccccggccagcgccgcgcagcggcgcggccggaucgggcgcaaccccgcccaggaggacgaccaguacgucuucuccggcgacccccugaagaacgacgaggaccacgcccacuggaccgaggccaagaugcugcucgacaacaucuacacgcccgaggggaucaucccgacccuguucggccccgagcgggagaagacccaggccaucgacggcgaguuccgccugcgcggggagcagcgcaagaccuucguggagcucaugcggcgcggcgaccugcccguguggcugagcuacaaggucgcguccgccgggaucagcuacaaggaccgggaguggugcuucacgggcgagcgcaacaaccagauccucgaggagaacauggagguggagaucuggacccgggagggggagaagaagaagcugcgccccaaguggcuggacgcccggguguacgccgacccgauggcccucaaggacuucaaggaguucgcguccggccgcaagagcaccacccuggacauccugacggagaucgccacccuccccaccuaccuguccagcaaggccaagcuggcccucgacaacaucgucaugcugcacaccaccgagaagggcgggcgcgccuaccagcacgcgcugaacgagcuccccgagucccuggagacgcugaugcucguggcccugcugggcgccaugaccgccgggaucuuccucuucuucaugcagggcaaggggaucggcaagcugagcaugggccugaucgcgaucgccguggccuccgggcuccugugggucgccgagauccagccgcaguggaucgccgcgagcaucauccuggaguucuuccucauggugcugcugauccccgagcccgagaagcagcggacgccccaggacaaccagcucaucuacgugauccugaccauccugacgaucaucggccucaucgccgccaacgagauggggcugaucgagaagaccaagaccgacuucggcuucuaccaggucaagaccgagacgaccauccuggacguggaccuccgcccggccagcgccuggacccuguacgcgguggccaccacgauccugacccccaugcuccggcacaccaucgagaacauguccgccaaccugagccuggccgccaucgcgaaccaggccgccguccucauggggcugggcaagggcuggccccugcaccgcauggaccucggggugccccugcuggccaugggcugcuacucccaggugaacccgaccacgcucaccgccagccuggucaugcugcucauccacuacgcgaucaucgggcccggccugcaggccaaggccacccgggaggcccagaagcgcaccgcggccggcaucaugaagaaccccacgguggacgggaucaccgugaucgaccuggagcccaucuccuacgacccgaaguucgagaagcagcucggccaggucaugcugcuggugcucugcguggggcagcugcugcucaugcggaccaccugggcccugugcgagguccugacgcucgccaccggccccaucaugacccugugggaggggaaccccggccgcuucuggaacaccacgaucgccgugagcaccgcgaacaucuuccggggcuccuaccuggccggggccggccucgccuucagccugaucaagaacgcccagacgccccgccgggggaccggcacgaccggggagacccugggcgagaaguggaagcgccagcucaacucccuggaccggaaggaguucgaggaguacaagcgcagcggcauccuggagguggaccggaccgaggcgaaguccgcccuccgcgacgggagcaagaucaagcacgccgucucccggggcagcuccaagauccgcuggaucguggagcgggggaugaucaagccgaagggcaagguggucgaccuggggugcggccgcggcggguggagcuacuacauggccacgcugaagaacgugaccgaggugaagggcuacaccaagggcggccccgggcacgaggagcccauccccauggccaccuacggcuggaaccucgucaagcugcacuccggcguggacguguucuacaagccgaccgagcaggucgacacgcugcucugcgacaucggggagagcuccagcaaccccaccaucgaggagggccgcacccugcggauccugaagaugguggagcccuggcucagcuccaagcccgaguucugcaucaaggugcugaacccguacaugcccaccgucaucgaggagcuggagaagcuccagcgccggcacgggggcagccuggugcgcugcccccugucccggaacagcacgcacgagauguacuggguguccggcgcgagcgggaacaucgucuccagcgugaacaccaucuccaagaugcugcucaaccgcuucaccacccggcaccgcaagcccacguacgagaaggacgucgaccugggcgccgggacccggagcguguccaccgagaccgagaagccggacaugacgaucaucggccgccggcugcagcgccuccaggaggagcacaaggagaccuggcacuacgaccaggagaaccccuaccggaccugggccuaccacgggagcuacgaggcccccuccaccggcagcgcguccagcauggugaacggcgucgugaagcugcugacgaagccgugggacgugauccccauggucacccagcucgccaugaccgacaccacgcccuucgggcagcagcgcguguucaaggagaagguggacacccggacgccccagccgaagcugggcacccgcaugaucaugacgaccaccgccaacuggcugugggcccuccuggggaagaagaaguccccgcggcugugcacccgcgaggaguucaucagcaagguccggagcaacgccgcgaucggcgccguguuccaggaggagcagggguggacgagcgccaucgaggccgugaacgacagccgcuucugggagcucgucgacaaggagcgggcccugcaccaggagggcaagugcgaguccugcguguacaacaugaugggcaagcgcgagaagaagcugggggaguucggccgcgcgaaggggagccgggccaucugguacauguggcucggcgcccgcuuccuggaguucgaggcccugggguuccucaacgaggaccacugguucucccgggagaacagcugguccggcguggagggcgaggggcugcaccgccugggcuacauccucgaggacaucgacaagaaggacggggaccugaucuacgccgacgacaccgcgggcugggacacccggaucaccgaggacgaccugcucaacgaggagcugaucacggagcagauggcgccccaccacaagacccuggccaaggccaucuucaagcucaccuaccagaacaaggucgugaaggugcugcgccccacccccaagggcgcggucauggacaucaucagccggaaggaccagcgcggguccggccagguggggacguacggccugaacaccuucaccaacauggaggugcagcucauccggcagauggaggccgagggggucaucacccaggacgacaugcagaaccccaagggccugaaggagcgcguggagaaguggcugaaggagugcggcguggaccggcucaagcgcauggccaucagcggggacgacugcgucgugaagccccuggacgagcgguucuccaccagccuccuguuccugaacgacaugggcaaggugcgcaaggacgucccccagugggagccguccaagggguggaagaacuggcaggaggugcccuucugcagccaccacuuccacaagaucuucaugaaggacggccggucccuggugguccccugccgcaaccaggacgagcucaucgggcgggcccgcaucagccagggcgccggcuggucccugcgggagacggcgugccuggggaaggccuacgcccagauguggagccucauguacuuccaccgccgcgaccugcggcuggccuccauggccaucugcagcgcggugcccaccgagugguucccgaccagccgcaccacgugguccauccacgcccagcaccaguggaugaccaccgaggacaugcucaagguguggaaccgggucuggaucgaggacaaccccaacaugaccgacaagacgcccgugcacagcugggaggacauccccuaccugggcaagcgcgaggaccuguggugcgggucccucaucggccugagcucccgggccaccugggccaagaacauccacaccgccaucacccaggugcgcaaccugaucgggaaggaggaguacgucgacuacaugccggugaugaagcgguacagcucccccagcgaguccgagggcgugcucuga

SEQ ID NO: 10503 - RNA, 9867 nt, Artificial Sequence
  derived and/or modified CDS sequence (opt1) from DENV-4__KJ160504__SS-prME
agcaccaucacccugcucugccugauccccacggugauggccuuccaccuguccacccgcgacggcgagccgcucaugaucgucgccaagcacgagcgggggcgcccccugcuguucaagaccaccgagggcaucaacaagugcacgcucaucgcgauggaccugggggagaugugcgaggacaccgugaccuacaagugcccccugcucgugaacaccgagcccgaggacaucgacugcuggugcaaccugacgagcaccugggucauguacggcaccugcacccaguccggggagcggcgccgggagaagcgcagcguggcccugacgccgcacuccggcaugggccucgagacccgggccgagaccuggaugagcuccgagggggccuggaagcacgcccagcgcguggagagcuggauccugcggaaccccggcuucgcgcugcucgccggguucauggccuacaugaucggccagaccgggauccagcgcacggucuucuucgugcugaugaugcugguggcccccuccuacggcaugcggugcgucggcguggggaaccgcgacuucguggagggcgucagcgggggcgcguggguggaccucgugcuggagcacggcgggugcgucaccaccauggcccagggcaagcccacccuggacuucgagcucacgaagaccaccgccaaggagguggcccugcugcggaccuacugcaucgaggccuccaucagcaacaucacgaccgcgacccgcugcccgacccagggggagcccuaccucaaggaggagcaggaccagcaguacaucugccggcgcgacguggucgaccggggcugggggaacggcugcggccuguucgggaagggcgggguggugacgugcgccaaguucuccugcagcggcaagaucaccgggaaccugguccagaucgagaaccucgaguacaccgugguggucaccgugcacaacggcgacacgcacgccgucggcaacgacaccuccaaccacggggugaccgccaccaucacgccccgcagccccuccguggaggucaagcugccggacuacggcgagcugacccucgacugcgagccccggagcgggaucgacuucaacgagaugauccugaugaagaugaagaagaagaccuggcuggugcacaagcagugguuccucgaccugccccugcccuggaccgccggcgcggacaccuccgaggugcacuggaacuacaaggagcgcauggucacguucaaggugccgcacgccaagcggcaggacgugaccguccucgggagccaggagggcgccaugcacagcgcccuggccggcgcgaccgagguggacuccggggacggcaaccacauguucgccgggcaccugaagugcaaggugcgcauggagaagcuccgcaucaagggcaugagcuacaccaugugcuccggcaaguucagcaucgacaaggagauggccgagacgcagcacgggaccaccgucgugaaggugaaguacgagggcgccggggcccccugcaagguccccaucgagauccgggacgugaacaaggagaagguggucggccgcgugaucuccagcaccccccuggcggagaacacgaacuccgugaccaacaucgagcuggagccgcccuucggggacagcuacaucgucaucggcgugggcaacuccgcccucacccugcacugguuccggaaggggagcuccaucggcaagauguucgagagcaccuaccgcggggccaagcggauggccauccugggcgagacggcgugggacuucggguccgugggcggccucuucaccagccuggggaaggccguccaccagguguucggcuccguguacaccaccauguucgggggcgucagcuggaugauccgcauccugaucggguuccucgugcuguggaucggcacgaacucccggaacaccagcauggccaugaccugcaucgccgugggcgggaucacccuguuccugggcuucacgguccaggccgacauggggugcgugguguccuggagcggccgcgagcucaagugcgggagcggcaucuucgucguggacaacgugcacaccuggaccgagcaguacaaguuccagcccgagucccccgcgcggcuggccagcgccauccugaacgcccacaaggacggcgucugcgggauccgcuccaccacgcggcucgagaacgugauguggaagcagaucaccaacgagcugaacuacgugcugugggagggcgggcacgaccucaccgucguggccggcgacgugaagggcguccugaccaaggggaagcgcgcgcugacgccgcccgugagcgaccucaaguacuccuggaagaccuggggcaaggccaagaucuucacccccgaggcccggaacagcaccuuccugaucgacgggcccgacacguccgagugcccgaacgagcgccgggccuggaacagccuggagguggaggacuacggcuucgggauguucaccaccaacaucuggaugaaguuccgcgagggcuccagcgaggucugcgaccaccggcucauguccgccgcgaucaaggaccagaaggccgugcacgccgacaugggcuacuggaucgagagcuccaagaaccagaccuggcagaucgagaaggccagccugaucgaggugaagacgugccuguggcccaagacccacacccucugguccaacgggguccuggagagccagaugcugauccccaaguccuacgcgggcccguucagccagcacaacuaccgccagggguacgccacccagaccgugggccccuggcaccucgggaagcuggagaucgacuucggcgagugccccggcacgaccgugaccauccaggaggacugcgaccaccgggggcccagccugcgcaccacgaccgccuccggcaagcucgucacccaguggugcugccgcagcugcaccaugccgccccugcgguuccugggggaggacggcugcugguacgggauggagauccgcccccucuccgagaaggaggagaacauggugaagagccaggucacggccggccagggcaccuccgagaccuucagcauggggcugcugugccucacccuguucguggaggagugccugcggcgccgggugacgcgcaagcacaugauccucgucguggugaucacccugugcgccaucauccugggcgggcucaccuggauggaccugcugcgggcgcucaucaugcugggcgacaccauguccggccgcaucgggggccagauccaccuggccaucauggccgucuucaagaugagccccggguacgugcucggcguguuccugcggaagcugacgucccgcgagaccgcccucauggucaucgggauggccaugaccaccgugcugagcaucccgcacgaccugauggagcucaucgacggcaucucccugggccugauccuccugaagaucgugacgcaguucgacaacacccaggucgggacccuggcgcucagccugaccuucauccgguccacgaugccccuggugauggccuggcgcaccaucauggccgugcucuucgucgugacccugaucccccugugccggaccagcugccuccagaagcagucccacuggguggagaucacggcccugauccugggcgcccaggcgcuccccgucuaccugaugacccugaugaagggggccagccgccgguccuggccgcucaacgagggcaucauggccguggggcuggugagccugcucggcuccgcccugcugaagaacgacgucccccucgcgggccccaugguggccgggggccugcugcucgccgccuacgugaugagcgggagcuccgccgaccugagccuggagaaggcggccaacguccagugggacgagauggccgacaucaccggcuccagccccaucaucgaggugaagcaggacgaggacggguccuucagcauccgcgacguggaggagaccaacaugaucacgcuccuggucaagcuggcccucaucaccguguccggccuguacccgcuggccauccccaucaccaugacccucugguacauguggcaggugaagacgcagcggagcggcgcgcugugggacguccccucccccgccgccacccagaaggccgcccugagcgaggggguguaccgcaucaugcagcggggccucuucgggaagacccaggugggcgucgggauccacauggagggcguguuccacaccauguggcacgugacccgcggcuccgucaucugccacgagacggggcggcuggagccgagcugggcggacgugcgcaacgacaugaucuccuacggcgggggcuggcgccugggcgacaagugggacaaggaggaggacgugcagguccucgccaucgagcccgggaagaaccccaagcacgugcagaccaagcccggccuguucaagacccugaccggggagaucggcgccgugacgcucgacuucaagccggggaccagcggcucccccaucaucaaccggaagggcaaggucaucgggcuguacggcaacgggguggugaccaagagcggcgacuacgucuccgccaucacccaggccgagcgcaucggggagcccgacuacgagguggacgaggacaucuuccggaagaagcgccugacgaucauggaccuccacccgggcgcgggcaagaccaagcggauccugcccagcaucgugcgcgaggcccugaagcggcgccugcggacccucauccuggcccccacccgcgucguggccgcggagauggaggaggcccugcgggggcuccccauccgcuaccagacgccggccgugaaguccgagcacaccggccgggagaucgucgaccugaugugccacgccaccuucaccacgcgccugcucagcagcacccgggugcccaacuacaaccugaucgucauggacgaggcccacuucaccgaccccuccagcguggcggcccgcggguacaucuccacccggguggagaugggcgaggccgccgccaucuucaugacggcgacccccccgggggccaccgaccccuucccccagagcaacucccccaucgaggacaucgagcgcgagaucccggagcggagcuggaacaccggcuucgacuggaucacggacuaccagggcaagaccgucugguucgugcccuccaucaaggccgggaacgacaucgccaacugccugcgcaagagcggcaagaaggugauccagcucucccgcaagaccuucgggaccgaguaccccaagacgaagcugaccgacugggacuucgucgugaccaccgacaucagcgagaugggcgccaacuuccgggcggggcgcgugaucgacccccggcgcugccugaagccggucauccucacggacggccccgagcgggugauccuggccggccccauccccgugaccccggccuccgccgcgcagcgccgggggcgcgucggccggaaccccgcccaggaggacgaccaguacguguucagcggggacccccugaagaacgacgaggaccacgcccacuggaccgaggccaagaugcuccuggacaacaucuacacccccgagggcaucaucccgacgcuguucggccccgagcgcgagaagacccaggccaucgacggggaguuccggcuccgcggcgagcagcggaagaccuucguggagcugaugcgccggggggaccugcccgucuggcucuccuacaagguggcgagcgccggcaucuccuacaaggaccgcgaguggugcuucaccggggagcggaacaaccagauccuggaggagaacauggagguggagaucuggacgcgcgagggcgagaagaagaagcugcggccccgcuggcucgacgcccgggucuacgccgacccgauggcccugaaggacuucaaggaguucgcgagcggccgcaaguccaucacccuggacauccucaccgagaucgccagccugcccgccuaccuguccagccgcgccaagcucgcccuggacaacaucgugaugcugcacaccaccgagcgggggggccgcgcguaccagcacgcccucaacgagcugcccgagagccuggagacgcucaugcugguggcccugcucggggccaugaccgcgggcaucuuccuguucuucaugcaggggaagggcaucggcaagcuguccauggggcucaucaccaucgccgucgccagcggccugcuguggaucgccgagauccagccgcaguggaucgccgcguccaucauccucgaguucuuccugauggugcugcucauccccgagcccgagaagcagcggaccccccaggacaaccagcugaucuacgugauccugacgguccucaccaucaucgggcugaucgccgccaacgagaugggccugaucgagaagaccaagaccgacuucggguucuaccaggugaagacggagaccaccauccucgacguggaccugcgcccggccagcgccuggacccuguacgcggucgccacgaccgugcucacccccaugcugcggcacaccaucgagaacacguccgccaaccugagccucgccgccaucgcgaaccaggccgccgugcugaugggccugggcaagggguggccccuccaccgcauggaccugggcgucccccugcucgccauggggugcuacucccaggugaacccgaccacccugaccgccagccuggugaugcucuucguccacuacgcgaucaucggccccggccugcaggccaaggccacgcgggaggcccagaagcgcaccgcggccgggaucaugaagaaccccaccguggacggcaucaccgugaucgaccuggagcccaucuccuacgacccgaaguucgagaagcagcucgggcaggucaugcugcuggugcucugcgccggccagcugcugcucaugcggacgaccugggccuucugcgaggugcugacccuggccaccgggcccauccucacgcugugggagggcaaccccggccgcuucuggaacaccaccaucgcggucagcaccgccaacaucuuccggggguccuaccuggccggcgccgggcucgccuucagccugaucaagaacgcgcagacgccccgccggggcaccgggaccaccggcgagacgcugggcgagaaguggaagcgccagcucaacucccuggaccggaaggaguucgaggaguacaagcgcagcgggauccuggagguggaccggaccgaggccaaguccgcccucaaggacggcagcaagaucaagcacgccgugucccgcgggagcuccaagauccgguggaucgucgagcgcggcauggugaagccgaaggggaagguggucgaccugggcugcggccgcgggggcuggagcuacuacauggccacccugaagaacgugaccgaggugaagggguacaccaagggcgggcccggccacgaggagcccauccccauggcgacguacggcuggaaccucgucaagcugcacagcgggguggacguguucuacaagccgaccgagcaggucgacacccugcucugcgacaucggcgaguccagcuccaaccccaccaucgaggaggggcggacgcugcgcgugcugaagauggucgagcccuggcucagcuccaagcccgaguucugcaucaaggugcugaacccguacaugcccaccgugaucgaggagcuggagaagcugcagcggaagcacggcggcaaccucguccgcugcccccugagccggaacuccacccacgagauguacugggugagcggggccuccggcaacaucgugagcuccgucaacaccacgagcaagaugcugcucaaccgcuucaccacccggcaccgcaagcccaccuacgagaaggacguggaccugggggccggcacgcgguccgugagcaccgagaccgagaagccggacaugaccaucaucgggcgccggcugcagcgccuccaggaggagcacaaggagacguggcacuacgaccaggagaaccccuaccggaccugggccuaccacggcuccuacgaggcgcccagcaccggcuccgccagcuccauggucaacgggguggugaagcugcugaccaagccgugggacgucauccccauggugacgcagcucgccaugaccgacaccacccccuucggccagcagcgcguguucaaggagaaggucgacacgcggaccccccagccgaagcccgggacccgcauggugaugaccacgaccgccaacuggcugugggcccugcucggcaagaagaagaacccccggcugugcacccgcgaggaguucaucagcaaggugcggagcaacgcggccaucggggccgucuuccaggaggagcagggcuggaccuccgccagcgaggccgugaacgacucccgcuucugggagcugguggacaaggagcgggcgcuccaccaggagggcaagugcgagagcugcgucuacaacaugauggggaagcgcgagaagaagcugggcgaguucgggcgcgccaagggcucccgggccaucugguacauguggcugggggcccgcuuccucgaguucgaggcccugggcuuccugaacgaggaccacugguucggccgggagaacagcugguccgggguggagggcgaggggcuccaccgccugggcuacauccuggaggagaucgacaagaaggacggcgaccucauguacgcggacgacacggccgggugggacacccggaucaccgaggacgaccugcagaacgaggagcugaucaccgagcagauggccccccaccacaagauccucgccaaggcgaucuucaagcugacguaccagaacaagguggucaaggugcugcgcccgaccccccggggcgccgugauggacaucaucagccgcaaggaccagcggggguccggccaggucgggaccuacggccucaacaccuucaccaacauggaggugcagcugauccgccagauggaggccgagggcgugaucacgcaggacgacaugcagaaccccaaggggcugaaggagcgggucgagaaguggcuccgcgagugcggcguggaccggcugaagcgcauggccaucagcggggacgacugcguggucaagccccuggacgagcgguucggcaccucccuccuguuccugaacgacauggggaaggugcgcaaggacaucccgcagugggagcccagcaagggcuggaagaacuggcaggaggugcccuucugcucccaccacuuccacaagaucuucaugaaggacggccggagccucgucgugcccugccgcaaccaggacgagcugaucgggcgggcccgcaucucccagggcgcgggguggagccugcgcgagaccgccugccucggcaaggccuacgcccagauguggucccugauguacuuccaccggcgcgaccugcggcucgccagcauggcgaucugcagcgccgugccgaccgagugguuccccacgucccgcaccaccuggagcauccacgcccaccaccaguggaugaccacggaggacaugcugaaggucuggaaccggguguggaucgaggacaaccccaacaugaccgacaagacccccgugcacuccugggaggacaucccguaccuggggaagcgcgaggaccucuggugcggcagccugaucggccuguccagccgggccaccugggccaagaacauccacacggcgaucacccagguccgcaaccucaucgggaaggaggaguacguggacuacaugcccgugaugaagcgguacuccgcccccagcgaguccgagggcguccuguga

SEQ ID NO: 10504 - RNA, 9867 nt, Artificial Sequence
  derived and/or modified CDS sequence (opt1) from DENV-4__GU289913__SS-prME
agcaccaucacccugcucugccugauccccaccgugauggccuuccaccuguccacccgcgacggcgagccgcucaugaucguggccaagcacgagcgggggcgcccccugcuguucaagaccaccgagggcaucaacaagugcacccucaucgcgauggaccugggggagaugugcgaggacaccgugaccuacaagugcccccugcucgugaacaccgagcccgaggacaucgacugcuggugcaaccugaccagcaccugggugauguacgggaccugcacccaguccggggagcggcgccgggagaagcgcagcguggcccugaccccgcacuccggcaugggccucgagacccgggccgagaccuggaugagcuccgagggggccuggaagcacgcccagcgcguggagagcuggauccugcggaaccccggcuucgcgcugcucgccggguucauggccuacaugaucggccagaccgggauccagcgcacgguguucuucgugcugaugaugcugguggcccccuccuacggcaugcggugcgucggcguggggaaccgcgacuucguggagggcgucagcgggggcgcguggguggaccucgugcuggagcacggcgggugcgucaccaccauggcccagggcaagcccacccuggacuucgagcucacgaagaccaccgccaaggagguggcccugcugcggaccuacugcaucgaggccuccaucagcaacaucacgaccgcgacccgcugcccgacccagggggagcccuaccucaaggaggagcaggaccagcaguacaucugccggcgcgacguggucgaccggggcugggggaacggcugcggccuguucgggaagggcgggguggugacgugcgccaaguucuccugcagcggcaagaucaccgggaaccugguccagaucgagaaccucgaguacaccgugguggucaccgugcacaacggcgacacgcacgccgucggcaacgacaccuccaaccacggggugaccgccaugaucacgccccggagccccuccguggaggucaagcugccggacuacggcgagcugacgcucgacugcgagccccggagcgggaucgacuucaacgagaugauccugaugaagaugaagaagaagaccuggcuggugcacaagcagugguuccucgaccugccccugcccuggaccgccggcgcggacaccuccgaggugcacuggaacuacaaggagcgcauggucaccuucaaggugccgcacgccaagcggcaggacgugacgguccucgggagccaggagggcgccaugcacagcgcccuggccggcgcgaccgagguggacuccggggacggcaaccacauguucgccgggcaccugaagugcaaggugcgcauggagaagcuccgcaucaagggcaugagcuacaccaugugcuccggcaaguucagcaucgacaaggagauggccgagacccagcacgggacgaccgucgugaaggugaaguacgagggcgccggggcccccugcaagguccccaucgagauccgggacgugaacaaggagaagguggucggccgcaucaucuccagcacgccccuggcggagaacaccaacuccgugacgaacaucgagcuggagccgcccuucggggacagcuacaucgugaucggcgucggcaacuccgcccucacccugcacugguuccggaaggggagcuccaucggcaagauguucgagagcaccuaccgcggggccaagcggauggccauccugggcgagaccgcgugggacuucggguccgugggcggccucuucacgagccuggggaaggccgugcaccaggucuucggcuccguguacaccaccauguucgggggcgugagcuggaugauccgcauccugaucggguuccucguccuguggaucggcaccaacucccggaacacgagcauggccaugaccugcaucgccgugggcgggaucacccuguuccugggcuucaccgugcaggccgacauggggugcgucguguccuggagcggcaaggagcucaagugcgggagcggcaucuucguggucgacaacgugcacacguggaccgagcaguacaaguuccagcccgagucccccgcgcgccuggccagcgccauccugaacgcccacaaggacggcgugugcgggauccgguccaccacccgccucgagaacgucauguggaagcagaucacgaacgagcugaacuacgugcugugggagggcgggcacgaccucaccguggucgccggcgacgugaagggcgugcugaccaaggggaagcgggcgcugaccccgcccgucagcgaccucaaguacuccuggaagacguggggcaaggccaagaucuucacccccgaggcccgcaacagcaccuuccugaucgacgggcccgacaccuccgagugcccgaacgagcggcgcgccuggaacagccuggagguggaggacuacggcuucgggauguucacgaccaacaucuggaugaaguuccgggagggcuccagcgaggugugcgaccaccgccucauguccgccgcgaucaaggaccagaaggccguccacgccgacaugggcuacuggaucgagagcuccaagaaccagaccuggcagaucgagaaggccagccugaucgaggugaagaccugccuguggcccaagacgcacacccucugguccaacggggugcuggagagccagaugcugauccccaaguccuacgcgggcccguucagccagcacaacuaccggcagggguacgccacccagaccgucggccccuggcaccucgggaagcuggagaucgacuucggcgagugccccggcaccacggugaccauccaggaggacugcgaccaccgcgggcccagccugcggaccaccacggccuccggcaagcucgugacccaguggugcugccgcagcugcaccaugccgccccugcgcuuccugggggaggacggcugcugguacgggauggagauccggccccucuccgagaaggaggagaacauggucaagagccaggugaccgccggccagggcacguccgagaccuucagcauggggcugcugugccucacccuguucgucgaggagugccugcgccggcgcgugacccggaagcacaugauccucguggucgugaucacgcugugcgccaucauccugggcgggcucaccuggauggaccugcugcgcgcgcucaucaugcugggcgacaccauguccggccggaucgggggccagauccaccuggccaucauggccguguucaagaugagccccggguacguccucggcguguuccugcgcaagcugaccucccgggagacggcccucauggugaucgggauggccaugaccaccguccugagcaucccgcacgaccugauggagcucaucgacggcaucucccugggccugauccuccugaagaucgugacccaguucgacaacacccagguggggacccuggcgcucagccugaccuucauccgcuccaccaugccccuggucauggccuggcggacgaucauggccguccucuucguggucacccugaucccccugugccgcaccagcugccuccagaagcagucccacuggguggagaucaccgcccugauccugggcgcccaggcgcuccccguguaccugaugacgcugaugaagggggccagccggcgcuccuggccgcucaacgagggcaucauggccgucgggcuggugagccugcucggcuccgcccugcugaagaacgacgugccccucgcgggccccauggucgccgggggccugcugcucgccgccuacgugaugagcgggagcuccgccgaccugagccuggagaaggcggccaacgugcagugggacgagauggccgacaucaccggcuccagccccaucaucgaggucaagcaggacgaggacggguccuucagcauccgggacguggaggagaccaacaugaucacccuccuggugaagcuggcccucaucacggucuccggccuguacccgcuggccauccccgugaccaugacccucugguacauguggcaggucaagacccagcgcagcggcgcgcugugggacguccccucccccgccgccacgcagaaggccgcccugagcgaggggguguaccggaucaugcagcgcggccucuucgggaagacccaggugggcgucgggauccacauggagggcguguuccacaccauguggcacgugacccggggcuccgucaucugccacgagaccgggcgccuggagccgagcugggcggacgugcggaacgacaugaucuccuacggcgggggcuggcgccugggcgacaagugggacaaggaggaggacgugcagguccucgccaucgagcccgggaagaaccccaagcacgugcagacgaagcccggccuguucaagacccugaccggggagaucggcgccgugacccucgacuucaagccggggacgagcggcucccccaucaucaaccgcaagggcaaggucaucgggcuguacggcaacgggguggugaccaagagcggcgacuacgucuccgccaucacccaggccgagcggaucggggagcccgacuacgagguggacgaggacaucuuccgcaagaagcggcugaccaucauggaccuccacccgggcgcgggcaagacgaagcgcauccugcccagcaucgugcgggaggcccugaagcgccggcugcgcacccucauccuggcccccacccgggucguggccgcggagauggaggaggcccugcgcgggcuccccauccgguaccagaccccggccgugaaguccgagcacacgggccgcgagaucgucgaccugaugugccacgccaccuucaccacccggcugcucagcagcacgcgcgugcccaacuacaaccugaucgucauggacgaggcccacuucaccgaccccuccagcguggcggcccggggguacaucuccacccgcguggagaugggcgaggccgccgccaucuucaugaccgcgacgcccccgggggccaccgaccccuucccccagagcaacucccccaucgaggacaucgagcgggagaucccggagcgcagcuggaacaccggcuucgacuggaucaccgacuaccagggcaagacggucugguucgugcccuccaucaaggccgggaacgacaucgccaacugccugcgcaagagcggcaagaaggugauccagcucucccgcaagaccuucgacaccgaguaccccaagaccaagcugacggacugggacuucgucgugaccaccgacaucagcgagaugggggccaacuuccgcgcgggccgggugaucgacccccgccggugccugaagccggucauccucaccgacgggcccgagcgcgugauccuggccggccccauccccgugacgccggccuccgccgcgcagcggcgcggccggaucgggcgcaaccccgcccaggaggacgaccaguacgucuucagcggcgacccccugaagaacgacgaggaccacgcccacuggaccgaggccaagaugcuccuggacaacaucuacacccccgaggggaucaucccgacccuguucggccccgagcgggagaagacgcaggccaucgacggcgaguuccgccuccgcggggagcagcgcaagaccuucguggagcugaugcggcgcggcgaccugcccguguggcucuccuacaaggucgcgagcgccgggaucuccuacaaggaccgggaguggugcuucaccggcgagcgcaacaaccagauccuggaggagaacauggagguggagaucuggacccgggagggggagaagaagaagcugcgcccccgguggcucgacgcccgcguguacgccgacccgauggcccugaaggacuucaaggaguucgcgagcggccggaaguccaucacgcuggacauccucaccgagaucgccagccugcccaccuaccuguccagccgcgccaagcucgcccuggacaacaucgucaugcugcacaccaccgagcgcggcgggcgggccuaccagcacgcgcucaacgagcugcccgagagccuggagacgcucaugcugguggcccugcucggcgccaugaccgccgggaucuuccuguucuucaugcagggcaaggggaucggcaagcuguccaugggccucaucaccaucgcgguggccagcgggcugcugugggucgccgagauccagccgcaguggaucgccgccuccaucauccucgaguucuuccugauggugcugcucauccccgagcccgagaagcagcgcacgccccaggacaaccagcugaucuacgugauccugacgauccucaccaucaucggccugaucgcggccaacgagauggggcugaucgagaagaccaagaccgacuucggcuucuaccaggucaagacggagaccaccauccucgacguggaccugcggccggccagcgccuggacccuguacgccguggcgacgaccauccucacccccaugcugcgccacaccaucgagaacacguccgccaaccugagccucgccgccaucgccaaccaggcggccguccugauggggcugggcaagggcuggccccuccaccggauggaccugggggugccccugcucgccaugggcugcuacucccaggugaacccgaccacccugaccgccagccuggucaugcucuccgugcacuacgccaucaucgggcccggccugcaggcgaaggccacgcgcgaggcccagaagcggaccgccgcgggcaucaugaagaaccccaccguggacgggaucaccgucaucgaccuggagcccaucagcuacgacccgaaguucgagaagcagcucggccaggugaugcugcuggugcucugcgccgggcagcugcugcucaugcgcacgaccugggccuucugcgagguccugacccuggccaccggccccauccucacgcugugggaggggaaccccggccgguucuggaacaccaccaucgccguguccaccgcgaacaucuuccgcggcagcuaccuggccggggccggccucgccuucucccugaucaagaacgcccagacgccccggcgcgggaccggcaccaccggggagacgcugggcgagaaguggaagcggcagcucaacagccuggaccgcaaggaguucgaggaguacaagcgguccggcauccuggagguggaccgcaccgaggccaagagcgcccucaaggacggguccaagaucaagcacgccgucagccggggcuccagcaagauccgcuggaucguggagcgggggauggugaagccgaagggcaaggucguggaccuggggugcggccgcggcggguggagcuacuacauggccacccugaagaacgugaccgaggucaagggcuacaccaagggcgggcccgggcacgaggagcccauccccauggccacguacggcuggaaccucgugaagcugcacuccggcguggacgucuucuacaagccgaccgagcaggucgacacccugcucugcgacaucggggagagcuccagcaaccccaccaucgaggagggccgcacgcugcgggugcugaagauggucgagcccuggcucuccagcaagcccgaguucugcaucaaggugcugaacccguacaugcccaccgucaucgaggagcuggagaagcugcagcgcaagcacgggggcaaccucgugcggugcccccugucccgcaacagcacccacgagauguacuggguguccggcgcgagcgggaacaucgucuccagcgugaacaccacguccaagaugcugcucaaccgguucaccacccgccaccggaagcccaccuacgagaaggacguggaccugggcgccgggacgcgcagcgucuccaccgagaccgagaagccggacaugaccaucaucggccggcgccugcagcggcuccaggaggagcacaaggagacguggcacuacgaccaggagaaccccuaccgcaccugggccuaccacgggagcuacgaggcccccuccaccggcagcgcguccagcauggugaacggcguggucaagcugcugaccaagccgugggacgugauccccauggugacgcagcucgccaugaccgacaccacccccuucgggcagcagcgggucuucaaggagaagguggacacgcgcacgccccagccgaagcccggcacccggauggugaugaccacgaccgccaacuggcugugggcccugcucgggaagaagaagaacccccgccugugcacccgggaggaguucaucagcaagguccgcuccaacgccgcgaucggcgccguguuccaggaggagcagggguggaccagcgccuccgaggccgugaacgacagccgguucugggagcuggucgacaaggagcgcgcccuccaccaggagggcaagugcgaguccugcguguacaacaugaugggcaagcgggagaagaagcugggggaguucggccgcgcgaaggggagccgcgccaucugguacauguggcugggcgcccgguuccucgaguucgaggcccugggguuccugaacgaggaccacugguucggccgcgagaacuccuggagcggcguggagggggagggccuccaccggcugggguacauccuggaggagaucgacaagaaggacggcgaccucauguacgccgacgacacggcgggcugggacacccgcaucaccgaggacgaccugcagaacgaggagcugaucaccgagcagauggcgccccaccacaagauccucgccaaggccaucuucaagcugacguaccagaacaaggucgugaaggugcugcggccgacgccccgcggggcggucauggacaucaucucccggaaggaccagcggggcagcggccaggugggcaccuacgggcucaacaccuucaccaacauggaggugcagcugauccggcagauggaggccgagggcgucaucacgcaggacgacaugcagaaccccaagggccugaaggagcgcguggagaaguggcucaaggagugcgggguggaccggcugaagcgcauggccaucuccggcgacgacugcgucgugaagccccuggacgagcgguucgggaccagccuccuguuccugaacgacaugggcaaggugcgcaaggacaucccgcagugggagcccuccaagggguggaagaacuggcaggagguccccuucugcagccaccacuuccacaagaucuucaugaaggacggccggucccucguggugcccugccgcaaccaggacgagcugaucggccgggcccgcaucagccagggggccggcuggucccugcgggagaccgcgugccucgggaaggccuacgcccagauguggagccugauguacuuccaccgccgcgaccugcggcucgccagcauggccaucugcuccgcggucccgaccgagugguuccccacgagccgcaccaccugguccauccacgcccaccaccaguggaugaccacggaggacaugcugaagguguggaaccggguguggaucgaggacaaccccaacaugaccgacaagacccccguccacagcugggaggacaucccguaccugggcaagcgcgaggaccucuggugcgggucccugaucggccugagcucccgggccaccugggccaagaacauccacacggccaucacccaggugcgcaaccucaucggcaaggaggaguacguggacuacaugcccgucaugaagcgguacagcgcgcccuccgagagcgagggggugcuguga

SEQ ID NO: 10505 - RNA, 9867 nt, Artificial Sequence
  derived and/or modified CDS sequence (opt1) from DENV-4__KJ579243__SS-prME
agcaccaucacccugcucugccugauccccacggugauggccuuccaccuguccacccgcgacggcgagccccucaugaucguggccaagcacgagcgggggcggccccugcuguucaagaccaccgagggcaucaacaagugcacgcucaucgcgauggaccugggggagaugugcgaggacaccgugaccuacaagugcccccugcucgugaacaccgagcccgaggacaucgacugcuggugcaaccugacgagcaccugggugauguacgggaccugcacccaguccggggagcggcgccgggagaagcgcagcguggcccugacgccgcacuccggcaugggccucgagacccgggccgagaccuggaugagcuccgagggggccuggaagcacgcccagcgcguggagagcuggauccugcggaaccccggcuucgcgcugcucgccggguucauggccuacaugaucggccagaccgggauccagcgcacgguguucuucgugcugaugaugcugguggcccccuccuacggcaugcggugcgucggcguggggaaccgcgacuucguggagggcgucagcgggggcgcguggguggaccucgugcuggagcacggcgggugcgucaccaccauggcccagggcaagcccacccuggacuucgagcucacgaagaccaccgccaaggagguggcccugcugcggaccuacugcaucgaggcccucaucuccaacaucacgaccgcgacccgcugcccgacccagggggagcccuaccugaaggaggagcaggaccagcaguacaucugccggcgcgacguggucgaccggggcugggggaacggcugcggccuguucgggaagggcgggguggugacgugcgccaaguucagcugcuccggcaagaucaccgggaaccucguccagaucgagaaccuggaguacaccgugguggucaccgugcacaacggcgacacgcacgccgucggcaacgacaccagcaaccacggggugaccgccaccaucacgccccgcucccccagcguggaggucaagcugccggacuacggcgagcucacccuggacugcgagccccgguccgggaucgacuucaacgagaugauccugaugaagaugaagaagaagaccuggcucgugcacaagcagugguuccuggaccugccccuccccuggaccaccggcgccgacacgagcgaggugcacuggaacuacaaggagcgcauggucaccuucaaggugccgcacgcgaagcggcaggacgugaccguccuggggucccaggagggcgccaugcacagcgcccuggccggcgccaccgagguggacagcggggacggcaaccacauguucgcggggcaccucaagugcaaggugcgcauggagaagcugcgcaucaagggcauguccuacacgaugugcagcggcaaguucuccaucgacaaggagauggccgagacccagcacgggaccaccgucgugaaggugaaguacgagggcgccggggcccccugcaagguccccaucgagauccgggacgugaacaaggagaagguggucggccgcgugaucagcgccacgccccuggcggagaacaccaacuccgugaccaacaucgagcucgagccgcccuucggggacagcuacaucgucaucggcgugggcaacuccgcccugacccugcacugguuccggaaggggagcuccaucggcaagauguucgagagcacguaccgcggggccaagcggauggccauccucggcgagaccgcgugggacuucggguccgugggcggccuguucaccagccuggggaaggccguccaccagguguucggcuccguguacaccacgauguucgggggcgucagcuggaugauccgcauccucaucgggugccuggugcuguggaucggcaccaacucccggaacaccagcauggccaugaccugcaucgccgugggcgggaucacgcuguuccucggcuucaccguccaggccgacauggggugcgugguguccuggagcggccgcgagcugaagugcggguccggcaucuucgucguggacaacgugcacaccuggaccgagcaguacaaguuccagcccgagagccccgcgcggcuggccagcgccauccucaacgcccacaaggacggcgucugcgggauccgcuccacgacccggcuggagaacgugauguggaagcagaucaccaacgagcugaacuacgugcucugggagggcgggcacgaccugaccgucguggccggcgacgugaagggcguccugacgaaggggaagcgcgcgcucaccccgcccgccagcggccugaaguacuccuggaagaccugggggaaggccaagaucuucacccccgaggcccggaacagcacguuccugaucgacggccccgacaccuccgagugcccgaacgagcgccgggccuggaacagcuucgagguggaggacuacggguucggcauguucaccaccaacaucuggaugaaguuccgcgagggcuccagcgaggugugcgaccaccggcucauguccgcggccaucaaggaccagaaggccguccacgccgacaugggguacuggaucgagagcuccaagaaccagacguggcagaucgagcgcgcgagccugaucgaggugaagaccugccuguggcccaagacccacacccucugguccaacggcgugcuggagagccagaugcugauccccaaguccuacgccgggccguucagccagcacaacuaccggcagggcuacgccacccagacggucgggcccuggcaccucggcaagcuggagaucgacuucggcgagugccccgggaccaccgugaccauccaggagaacugcgaccaccgcggccccucccugcgcacgaccaccgccagcgggaagcucgugacccaguggugcugccggagcugcacgaugccgccccugcgcuuccugggcgaggacgggugcugguacggcauggagauccggccccucuccgagaaggaggagaacauggucaagagccaggugaccgccggccaggggaccuccgagaccuucagcaugggccugcugugccucacgcuguucgucgaggagugccugcgccggcgcgugacccggaagcacaugauccucgcgguggucaucacccugugcgccaucauccucggcgggcucaccuggauggaccugcugcgcgcccucaucauccugggggacacgauguccgggcggaucggcgggcagacccaccuggccaucauggccguguucaagaugagccccggcuacgugcucggggucuuccugcgcaagcugaccucccgggagaccgcgcucauggugaucggcauggccaugacgaccacccugagcaucccgcacgaccugauggagcucaucgacggcaucucccuggggcugauccuccugaagaucgugacccaguucgacaacacgcaggucggcacccuggcccucagccugaccuucauccgcuccaccaugagccuggugauggccuggcggacgaucauggccgugcuguucgucgugacccugaucccccugugccgcaccuccugccuccagaagcagagccacuggguggagaucaccgcgcugauccugggggcccaggcccuccccgucuaccugaugacgcugaugaagggcgccucccggcgcagcuggccccucaacgaggggaucauggcggugggccuggugucccugcucggcagcgcccugcugaagaacgacgucccgcucgccgggcccaugguggccggcgggcugcugcucgccgcguacgugauguccggcagcagcgccgaccugucccuggagaaggccgccaacguccagugggacgagauggccgacaucaccgggagcucccccaucaucgaggugaagcaggacgaggacggcagcuucuccauccgggacguggaggagaccaacaugaucacccuccuggucaagcuggcgcucaucacggugagcggccuguacccccuggccaucccgaucaccaugacccucugguacauguggcaggucaagacccagcgcuccggggcccugugggacguccccagccccgccgccacccagaaggcggcccuguccgagggcguguaccggaucaugcagcgcggccucuucggcaagacccaggugggggucggcauccacauggagggcguguuccacaccauguggcacgugacccgggggagcgucaucugccacgagaccggccgccuggagcccuccugggccgacgugcgcaacgacaugaucagcuacgggggcggcuggcggcugggggacaagugggacaaggaggaggacgugcagguccucgccaucgagccgggcaagaaccccaagcacgugcagacgaagcccgggcuguucaagacccugaccggcgagaucggggccgugacccucgacuucaagcccggcacguccggcagcccgaucaucaaccgcaaggggaaggucaucggccuguacgggaacggcguggugaccaaguccggggacuacgucagcgcgaucacccaggccgagcggaucggcgagcccgacuacgagguggacgaggacaucuuccgcaagaagcggcugaccaucauggaccuccaccccggcgccgggaagacgaagcgcauccugccguccaucgugcgggaggcccugaagcgccggcugcgcacccucauccuggcgcccacccgggucguggccgccgagauggaggaggcccugcgcggccuccccauccgguaccagacccccgccgucaagagcgagcacacggggcgcgagaucgucgaccugaugugccacgcgaccuucaccacccggcugcucuccagcacgcgcgugccgaacuacaaccugaucgugauggacgaggcccacuucaccgaccccagcuccgucgccgcccggggcuacaucagcacccgcguggagaugggggaggccgcggccaucuucaugaccgccacgccgcccggcgccaccgacccguucccccaguccaacagccccaucgaggacaucgagcgggagauccccgagcgcuccuggaacaccggcuucgacuggaucaccgacuaccaggggaagacggucugguucgugccgagcaucaaggccggcaacgacaucgcgaacugccugcgcaaguccgggaagaaggugauccagcucagccggaagaccuucgacaccgaguaccccaagaccaagcugacggacugggacuucgucgugaccaccgacaucuccgagaugggcgccaacuuccgcgccgggcgggugaucgacccccgccggugccugaagcccgucauccucaccgacggcccggagcgcgugauccuggccggccccauccccgugacgcccgcgagcgccgcccagcggcgcgggcggaucggccgcaacccggcccaggaggacgaccaguacgucuucuccggggacccccugaagaacgacgaggaccacgcccacuggaccgaggcgaagaugcuccuggacaacaucuacacccccgagggcaucauccccacccuguucggcccggagcgggagaagacgcaggccaucgacggggaguuccgccuccggggcgagcagcgcaagaccuucguggagcugaugcggcgcggggaccugcccguguggcucagcuacaaggucgccuccgccggcaucagcuacaaggaccgggaguggugcuucaccggggagcgcaacaaccagauccuggaggagaacauggagguggagaucuggacccgggagggcgagaagaagaagcugcgccccaaguggcucgacgcccggguguacgcggaccccauggcccugaaggacuucaaggaguucgccuccggccgcaagagcaucacccuggacauccucacggagaucgccucccugccgaccuaccugagcucccgcgccaagcucgcgcuggacaacaucgucaugcugcacaccaccgagcgcgggggccgcgccuaccagcacgcccucaacgagcugcccgagagccuggagacgcucaugcugguggcccugcucggggcgaugaccgccggcaucuuccuguucuucaugcaggggaagggcaucggcaagcugagcauggggcucaucaccaucgccguggccuccggccugcugugggucgccgagauccagccccaguggaucgcggccagcaucauccucgaguucuuccugauggugcugcucaucccggagcccgagaagcagcggacgccccaggacaaccagcugaucuacgugauccugacgauccucaccaucaucgggcugaucgccgccaacgagaugggccugaucgagaagaccaagaccgacuucggguucuaccaggucaagacggagaccaccauccucgacguggaccugcgccccgccuccgcguggacccuguacgccguggccacgaccauccucaccccgaugcugcggcacaccaucgagaacacgagcgccaaccugucccucgccgcgaucgccaaccaggccgccguccugaugggccugggcaagggguggccccuccaccgcauggaccugggcgugccccugcucgccauggggugcuacagccaggugaaccccaccacccugaccgcgucccuggucaugcuccuggugcacuacgccaucaucggcccgggccugcaggccaaggccacgcgggaggcgcagaagcgcaccgccgccgggaucaugaagaaccccaccguggacggcaucaccgucaucgaccucgagcccaucagcuacgaccccaaguucgagaagcagcugggccaggugaugcugcucgugcugugcgccggccagcugcuccugaugcggacgaccugggccuucugcgagguccugacccucgcgaccgggccgauccugacgcugugggagggcaaccccggccgcuucuggaacaccaccaucgccguguccaccgccaacaucuuccgggggagcuaccucgccggcgccgggcuggcguucucccugaucaagaacgcccagacgccccgccggggcaccgggaccgccggcgagacccucggcgagaaguggaagcgccagcugaacagccuggaccggaaggaguucgaggaguacaagcgcuccgggauccucgagguggaccggaccgaggccaagagcgcccugaaggacggcuccaagaucaagcacgcggucagccgcggguccagcaagauccgguggaucguggagcgcggcauggugaagcccaaggggaaggucguggaccugggcugcggccgcgggggcugguccuacuacauggccacgcucaagaacgugaccgaggucaagggguacaccaagggcgggccgggccacgaggagcccauccccauggccaccuacggcuggaaccuggugaagcugcacagcgggguggacgucuucuacaagcccacggagcaggucgacacccuccugugcgacaucggcgagagcuccagcaacccgaccaucgaggaggggcggacccugcgcgugcucaagauggucgagcccuggcuguccagcaagcccgaguucugcaucaaggugcugaaccccuacaugccgacggugaucgaggagcuggagaagcuccagcggaagcacggcggcaaccugguccgcugcccccugucccggaacagcacccacgagauguacuggguguccggggccagcggcaacaucgucuccagcgugaacaccaccuccaagaugcuccugaaccgcuucacgacccggcaccgcaagcccaccuacgagaaggacguggaccugggggcgggcacccggagcgucuccacggagaccgagaagcccgacaugaccaucaucgggcgccggcuccagcgccugcaggaggagcacaaggagaccuggcacuacgaccaggagaacccguaccggacgugggccuaccacggcagcuacgaggcccccuccaccggcagcgccuccagcauggugaacgggguggucaagcugcucaccaagcccugggacgugaucccgauggugacccagcuggccaugacggacaccacccccuucggccagcagcgcgucuucaaggagaagguggacacccggacgccccagcccaagccggggacccgcauggugaugaccaccacggcgaacuggcugugggcccuccugggcaagaagaagaacccccggcugugcacccgcgaggaguucaucuccaagguccggagcaacgccgccaucggggccguguuccaggaggagcagggcuggaccagcgcguccgaggccgugaacgacagccgcuucugggagcucgucgacaaggagcgggcccugcaccaggagggcaagugcgaguccugcguguacaacaugauggggaagcgcgagaagaagcugggcgaguucgggcgcgccaagggcagccgggccaucugguacauguggcucggggcgcgcuuccuggaguucgaggcccugggcuuccucaacgaggaccacugguucggccgggagaacuccuggagcgggguggagggcgaggggcugcaccgccugggcuacauccucgaggagaucgacaagaaggacggcgaccugauguacgccgacgacaccgccgggugggacacgcggaucaccgaggacgaccugcagaacgaggagcucaucaccgagcagauggcgccccaccacaagauccuggccaaggccaucuucaagcugaccuaccagaacaaggucgugaaggugcuccgccccaccccgcggggcgccgucauggacaucaucucccgcaaggaccagcgggggagcggccagguggggacguacggccugaacaccuucaccaacauggaggugcagcugauccgccagauggaggccgagggcgucaucacccaggacgacaugcagaaccccaaggggcucaaggagcggguggagaaguggcugcgcgagugcggcguggaccggcugaagcgcauggcgaucuccggggacgacugcgucgugaagccccucgacgagcgguucggcacgagccugcuguuccucaacgacauggggaaggugcgcaaggacaucccccagugggagccguccaagggcuggaagaacuggcaggagguccccuucugcagccaccacuuccacaagaucuucaugaaggacggccggucccugguggugcccugccgcaaccaggacgagcugaucgggcgggcccgcaucagccagggcgccggguggucccuccgcgagaccgccugccugggcaaggccuacgcgcagauguggagccugauguacuuccaccggcgcgaccuccggcuggccuccauggccaucugcagcgccguccccaccgagugguucccgaccagccgcacgaccugguccauccacgcccaccaccaguggaugaccaccgaggacaugcugaagguguggaaccggguguggaucgaggacaaccccaacaugaucgacaagacgcccguccacagcugggaggacauccccuaccucgggaagcgcgaggaccuguggugcggcucccugaucggccucagcucccgggcgaccugggccaagaacauccacaccgccaucacccaggugcgcaaccugaucgggaaggaggaguacguggacuacaugccggucaugaagcgguacagcgcccccuccgagagcgagggcgugcuguga

SEQ ID NO: 10506 - RNA, 9867 nt, Artificial Sequence
  derived and/or modified CDS sequence (opt1) from DENV-4__KJ579246__SS-prME
agcaccaucacccugcucugccugauccccacggugauggccuuccaccuguccacccgcgacggcgagccgcucaugaucgucgccaagcacgagcgggggcgcccccugcuguucaagaccaccgagggcaucaacaagugcacgcucaucgcgauggaccugggggagaugugcgaggacaccgugaccuacaagugcccccugcucgugaacaccgagcccgaggacaucgacugcuggugcaaccugacgagcaccugggucauguacggcaccugcacccaguccggggagcggcgccgggagaagcgcagcguggcccugacgccgcacuccggcaugggccucgagacccgggccgagaccuggaugagcuccgagggggccuggaagcacgcccagcgcguggagagcuggauccugcggaaccccggcuucgcgcugcucgccggguucauggccuacaugaucggccagaccgggauccagcgcacggucuucuucgugcugaugaugcugguggcccccuccuacggcaugcggugcgucggcguggggaaccgcgacuucguggagggcgucagcgggggcgcguggguggaccucgugcuggagcacggcgggugcgucaccaccauggcccagggcaagcccacccuggacuucgagcucacgaagaccaccgccaaggagguggcccugcugcggaccuacugcaucgaggcccucaucuccaacaucacgaccgcgacccgcugcccgacccagggggagcccuaccugaaggaggagcaggaccagcaguacaucugccggcgcgacguggucgaccggggcugggggaacggcugcggccuguucgggaagggcgggguggugacgugcgccaaguucagcugcuccggcaagaucaccgggaaccucguccagaucgagaaccuggaguacaccgugguggucaccgugcacaacggcgacacgcacgccgucggcaacgacaccagcaaccacggggugaccgccaccaucacgccccgcucccccagcguggaggucaagcugccggacuacggcgagcucacccuggacugcgagccccgguccgggaucgacuucaacgagaugauccugaugaagaugaagaagaagaccuggcucgugcacaagcagugguuccuggaccugccccuccccuggaccaccggcgccgacacgagcgaggugcacuggaacuacaaggagcgcauggucaccuucaaggugccgcacgcgaagcggcaggacgugaccguccuggggucccaggagggcgccaugcacagcgcccuggccggcgccaccgagguggacagcggggacggcaaccacauguucgcggggcaccucaagugcaaggugcgcauggagaagcugcgcaucaagggcauguccuacacgaugugcagcggcaaguucuccaucgacaaggagauggccgagacccagcacgggaccaccgucgugaaggugaaguacgagggcgccggggcccccugcaagguccccaucgagauccgggacgugaacaaggagaagguggucggccgcgugaucagcgccacgccccuggcggagaacaccaacuccgugaccaacaucgagcucgagccgcccuucggggacagcuacaucgucaucggcgugggcaacuccgcccugacccugcacugguuccggaaggggagcuccaucggcaagauguucgagagcacguaccgcggggccaagcggauggccauccucggcgagaccgcgugggacuucggguccgugggcggccuguucaccagccuggggaaggccguccaccagguguucggcuccguguacaccacgauguucgggggcgucagcuggaugauccgcauccucaucggguuccuggugcuguggaucggcaccaacucccggaacaccagcauggccaugaccugcaucgccgugggcgggaucacgcuguuccucggcuucaccguccaggccgacauggggugcgugguguccuggagcggccgcgagcugaagugcggguccggcaucuucgucguggacaacgugcacaccuggaccgagcaguacaaguuccagcccgagagccccgcgcggcuggccagcgccauccucaacgcccacaaggacggcgucugcgggauccgcuccacgacccggcuggagaacgugauguggaagcagaucaccaacgagcugaacuacgugcucugggagggcgggcacgaccugaccgucguggccggcgacgugaagggcguccugacgaaggggaagcgcgcgcucaccccgcccgccagcgaccugaaguacuccuggaagaccuggggcaaggccaagaucuucacccccgaggcccggaacagcacguuccugaucgacgggcccgacaccuccgagugcccgaacgagcgccgggccuggaacagcuucgagguggaggacuacggcuucgggauguucaccaccaacaucuggaugaaguuccgcgagggcuccagcgaggugugcgaccaccggcucauguccgcggccaucaaggaccagaaggccguccacgccgacaugggcuacuggaucgagagcuccaagaaccagacguggcagaucgagcgcgcgagccugaucgaggugaagaccugccuguggcccaagacccacacccucugguccaacggggugcuggagagccagaugcugauccccaaguccuacgccggcccguucagccagcacaacuaccggcagggguacgccacccagacggucggccccuggcaccucgggaagcuggagaucgacuucggcgagugccccggcaccaccgugaccauccaggagaacugcgaccaccgcgggcccucccugcgcacgaccaccgccagcggcaagcucgugacccaguggugcugccggagcugcacgaugccgccccugcgcuuccugggggaggacggcugcugguacgggauggagauccggccccucuccgagaaggaggagaacauggucaagagccaggugaccgccggccagggcaccuccgagaccuucagcauggggcugcugugccucacgcuguucgucgaggagugccugcgccggcgcgugacccggaagcacaugauccucgcgguggucaucacccugugcgccaucauccugggcgggcucaccuggauggaccugcugcgcgcccucaucauccugggcgacacgauguccggccggaucgggggccagacccaccuggccaucauggccguguucaagaugagccccggguacgugcucggcgucuuccugcgcaagcugaccucccgggagaccgcgcucauggugaucgggauggccaugacgaccacccugagcaucccgcacgaccugauggagcucaucgacggcaucucccugggccugauccuccugaagaucgugacccaguucgacaacacgcaggucgggacccuggcccucagccugaccuucauccgcuccaccaugagccuggugauggccuggcggacgaucauggccgugcucuucgucgugacccugaucccccugugccgcaccuccugccuccagaagcagagccacuggguggagaucaccgcgcugauccugggcgcccaggcccuccccgucuaccugaugacgcugaugaagggggccucccggcgcagcuggccccucaacgagggcaucauggcgguggggcuggugucccugcucggcagcgcccugcugaagaacgacgucccgcucgccggccccaugguggccgggggccugcugcucgccgcguacgugauguccgggagcagcgccgaccugucccuggagaaggccgccaacguccagugggacgagauggccgacaucaccggcagcucccccaucaucgaggugaagcaggacgaggacgggagcuucuccauccgggacguggaggagaccaacaugaucacccuccuggucaagcuggcgcucaucacggugagcggccuguacccccuggccaucccgaucaccaugacccucugguacauguggcaggugaagacccagcgcuccggcgcccugugggacguccccagccccgccgccacccagaaggcggcccuguccgaggggguguaccggaucaugcagcgcggccucuucgggaagacgcaggugggcgucgggauccacauggagggcguguuccacaccauguggcacgugacccggggcagcgucaucugccacgagaccgggcgccuggagcccuccugggccgacgugcgcaacgacaugaucagcuacggcgggggcuggcggcugggcgacaagugggacaaggaggaggacgugcagguccucgccaucgagccggggaagaaccccaagcacgugcagacgaagcccggccuguucaagacccugaccggggagaucggcgccgugacccucgacuucaagcccgggacguccggcagcccgaucaucaaccgcaagggcaaggucaucgggcuguacggcaacgggguggugaccaaguccggcgacuacgucagcgcgaucacccaggccgagcggaucggggagcccgacuacgagguggacgaggacaucuuccgcaagaagcggcugaccaucauggaccuccaccccggcgccggcaagacgaagcgcauccugccguccaucgugcgggaggcccugaagcgccggcugcgcacccucauccuggcgcccacccgggucguggccgccgagauggaggaggcccugcgcgggcuccccauccgguaccagacccccgccgugaagagcgagcacacgggccgcgagaucgucgaccugaugugccacgcgaccuucaccacccggcugcucuccagcacgcgcgugccgaacuacaaccugaucgugauggacgaggcccacuucaccgaccccagcuccgucgccgcccggggguacaucagcacccgcguggagaugggcgaggccgcggccaucuucaugaccgccacgccccccggggccaccgacccguucccccaguccaacagccccaucgaggacaucgagcgggagauccccgagcgcuccuggaacaccggcuucgacuggaucaccgacuaccagggcaagacggucugguucgugccgagcaucaaggccgggaacgacaucgcgaacugccugcgcaaguccggcaagaaggugauccagcucagccggaagaccuucgacaccgaguaccccaagaccaagcugacggacugggacuucgucgugaccaccgacaucuccgagaugggggccaacuuccgcgccggccgggugaucgacccccgccggugccugaagcccgucauccucaccgacgggccggagcgcgugauccuggccggccccauccccgugacgcccgcgagcgccgcccagcggcgcggccggaucgggcgcaacccggcccaggaggacgaccaguacgucuucuccggcgacccccugaagaacgacgaggaccacgcccacuggaccgaggcgaagaugcuccuggacaacaucuacacccccgaggggaucauccccacccuguucggcccggagcgggagaagacgcaggccaucgacggcgaguuccgccuccggggggagcagcgcaagaccuucguggagcugaugcggcgcggcgaccugcccguguggcucagcuacaaggucgccuccgccgggaucagcuacaaggaccgggaguggugcuucaccggcgagcgcaacaaccagauccuggaggagaacauggagguggagaucuggacccgggagggggagaagaagaagcugcgccccaaguggcucgacgcccggguguacgcggaccccauggcccugaaggacuucaaggaguucgccuccggccgcaagagcaucacccuggacauccucacggagaucgccucccugccgaccuaccugagcucccgcgccaagcucgcgcuggacaacaucgucaugcugcacaccaccgagcggggcgggcgcgccuaccagcacgcccucaacgagcugcccgagagccuggagacgcucaugcugguggcccugcucggcgcgaugaccgccgggaucuuccuguucuucaugcagggcaaggggaucggcaagcugagcaugggccucaucaccaucgccguggccuccgggcugcugugggucgccgagauccagccccaguggaucgcggccagcaucauccucgaguucuuccugauggugcugcucaucccggagcccgagaagcagcggaccccccaggacaaccagcugaucuacgugauccugacgauccucaccaucaucggccugaucgccgccaacgagauggggcugaucgagaagaccaagaccgacuucggcuucuaccaggucaagacggagaccaccauccucgacguggaccugcgccccgccuccgcguggacccuguacgccguggccacgaccauccucaccccgaugcugcggcacaccaucgagaacacgagcgccaaccugucccucgccgcgaucgccaaccaggccgccguccugauggggcugggcaagggcuggccccuccaccgcauggaccugggggugccccugcucgccaugggcugcuacagccaggugaaccccaccacccugaccgcgucccuggucaugcuccuggugcacuacgccaucaucgggccgggccugcaggccaaggccacgcgggaggcgcagaagcgcaccgccgccggcaucaugaagaaccccaccguggacgggaucaccgucaucgaccucgagcccaucagcuacgaccccaaguucgagaagcagcugggccaggugaugcugcucgugcugugcgccgggcagcugcuccugaugcggacgaccugggccuucugcgagguccugacccucgcgaccggcccgauccugacgcugugggaggggaaccccggccgcuucuggaacaccaccaucgccguguccaccgccaacaucuuccggggcagcuaccucgccggggccggccuggcguucucccugaucaagaacgcccagacgccccgccgggggaccggcaccgccggggagacccucggcgagaaguggaagcgccagcugaacagccuggaccggaaggaguucgaggaguacaagcgcuccggcauccucgagguggaccggaccgaggccaagagcgcccugaaggacggguccaagaucaagcacgcggucagccgcggcuccagcaagauccgguggaucguggagcgcgggauggugaagcccaagggcaaggucguggaccuggggugcggccgcggcgggugguccuacuacauggccacgcucaagaacgugaccgaggucaagggcuacaccaaggggggcccggggcacgaggagcccauccccauggccaccuacggcuggaaccuggugaagcugcacagcggcguggacgucuucuacaagcccacggagcagguggacacccuccugugcgacaucggggagagcuccagcaacccgaccaucgaggagggccggacccugcgcgugcucaagauggucgagcccuggcuguccagcaagcccgaguucugcaucaaggugcugaaccccuacaugccgacggugaucgaggagcuggagaagcuccagcggaagcacgggggcaaccugguccgcugcccccugucccggaacagcacccacgagauguacuggguguccggcgccagcgggaacaucgucuccagcgugaacaccaccuccaagaugcuccugaaccgcuucacgacccggcaccgcaagcccaccuacgagaaggacguggaccugggcgcggggacccggagcgucuccacggagaccgagaagcccgacaugaccaucaucggccgccggcuccagcgccugcaggaggagcacaaggagaccuggcacuacgaccaggagaacccguaccggacgugggccuaccacgggagcuacgaggcccccuccaccggcagcgccuccagcauggugaacggcguggucaagcugcucaccaagcccugggacgugaucccgauggugacccagcuggccaugacggacaccacccccuucgggcagcagcgcgucuucaaggagaagguggacacccggacgccccagcccaagccgggcacccgcauggugaugaccaccacggcgaacuggcugugggcccuccuggggaagaagaagaacccccggcugugcacccgcgaggaguucaucuccaagguccggagcaacgccgccaucggcgccguguuccaggaggagcagggguggaccagcgcguccgaggccgugaacgacagccgcuucugggagcucgucgacaaggagcgggcccugcaccaggagggcaagugcgaguccugcguguacaacaugaugggcaagcgcgagaagaagcugggggaguucggccgcgccaaggggagccgggccaucugguacauguggcucggcgcgcgcuuccuggaguucgaggcccugggguuccucaacgaggaccacugguucggccgggagaacuccuggagcggcguggagggggagggccugcaccgccugggguacauccucgaggagaucgacaagaaggacggcgaccugauguacgccgacgacaccgccggcugggacacgcggaucaccgaggacgaccugcagaacgaggagcucaucaccgagcagauggcgccccaccacaagauccuggccaaggccaucuucaagcugaccuaccagaacaaggucgugaaggugcuccgccccaccccgcggggggccgucauggacaucaucucccgcaaggaccagcggggcagcgggcaggugggcacguacgggcugaacaccuucaccaacauggaggugcagcugauccgccagauggaggccgagggcgucaucacccaggacgacaugcagaaccccaagggccucaaggagcggguggagaaguggcugcgcgagugcgggguggaccggcugaagcgcauggcgaucuccggcgacgacugcgucgugaagccccucgacgagcgguucgggacgagccugcuguuccucaacgacaugggcaaggugcgcaaggacaucccccagugggagccguccaagggguggaagaacuggcaggagguccccuucugcagccaccacuuccacaagaucuucaugaaggacggccggucccugguggugcccugccgcaaccaggacgagcugaucggccgggcccgcaucagccagggggccggcuggucccuccgcgagaccgccugccuggggaaggccuacgcgcagauguggagccugauguacuuccaccggcgcgaccuccggcuggccuccauggccaucugcagcgccguccccaccgagugguucccgaccagccgcacgaccugguccauccacgcccaccaccaguggaugaccaccgaggacaugcugaagguguggaaccggguguggaucgaggacaaccccaacaugaucgacaagacgcccauccacagcugggaggacauccccuaccucggcaagcgcgaggaccuguggugcgggucccugaucggccucagcucccgggcgaccugggccaagaacauccacaccgccaucacccagguccgcaaccugaucggcaaggaggaguacguggacuacaugccggugaugaagcgguacagcgcccccuccgagagcgaggggguccuguga

SEQ ID NO: 10507 - RNA, 9867 nt, Artificial Sequence
  derived and/or modified CDS sequence (opt1) from DENV-4__KJ579248__SS-prME
agcaccaucacccugcucugccugauccccaccgugauggccuuccaccuguccacccgggacggcgagccccucaugaucguggccaagcacgagcgggggcggccccugcuguucaagaccaccgagggcaucaacaagugcacgcucaucgcgauggaccugggggagaugugcgaggacaccgugaccuacaagugcccccugcucgugaacaccgagcccgaggacaucgacugcuggugcaaccugacgagcaccugggugauguacgggaccugcacccaguccggggagcggcgccgggagaagcgcagcguggcccugacgccgcacuccggcaugggccucgagacccgggccgagaccuggaugagcuccgagggggccuggaagcacgcccagcgcguggagagcuggauccugcggaaccccggcuucgcgcugcucgccggguucauggccuacaugaucggccagaccgggauccagcgcacggucuucuucgugcugaugaugcugguggcccccuccuacggcaugcggugcgucggcguggggaaccgcgacuucguggagggcgucagcgggggcgcguggguggaccucgugcuggagcacggcgggugcgucaccaccauggcccagggcaagcccacccuggacuucgagcucacgaagaccaccgccaaggagguggcccugcugcggaccuacugcaucgaggcccucaucuccaacaucacgaccgcgacccgcugcccgacccagggggagcccuaccugaaggaggagcaggaccagcaguacaucugccggcgcgacguggucgaccggggcugggggaacggcugcggccuguucgggaagggcgggguggugacgugcgccaaguucagcugcuccggcaagaucaccgggaaccucguccagaucgagaaccuggaguacaccgugguggucaccgugcacaacggcgacacgcacgccgucggcaacgacaccagcaaccacggggugaccgccaccaucacgccccgcucccccagcguggaggucaagcugccggacuacggcgagcucacccuggacugcgagccccgguccgggaucgacuucaacgagaugauccugaugaagaugaagaagaagaccuggcucgugcacaagcagugguuccuggaccugccccuccccuggaccaccggcgccgacacgagcgaggugcacuggaacuacaaggagcgcauggucaccuucaaggugccgcacgcgaagcggcaggacgugaccguccuggggucccaggagggcgccaugcacagcgcccuggccggcgccaccgagguggacagcggggacggcaaccacauguucgcggggcaccucaagugcaaggugcgcauggagaagcugcgcaucaagggcauguccuacacgaugugcagcggcaaguucuccaucgacaaggagauggccgagacccagcacgggaccaccgucgugaaggugaaguacgagggcgccggggcccccugcaagguccccaucgagauccgggacgugaacaaggagaagguggucggccgcgugaucagcgccacgccccuggcggagaacaccaacuccgugaccaacaucgagcucgagccgcccuucggggacagcuacaucgucaucggcgugggcaacuccgcccugacccugcacugguuccggaaggggagcuccaucggcaagauguucgagagcacguaccgcggggccaagcggauggccauccucggcgagaccgcgugggacuucggguccgugggcggccuguucaccagccuggggaaggccguccaccagguguucggcuccguguacaccacgauguucgggggcgucagcuggaugauccgcauccucaucggguuccuggugcuguggaucggcaccaacucccggaacaccagcauggccaugaccugcaucgccgugggcgggaucacgcuguuccucggcuucaccguccaggccgacauggggugcgugguguccuggagcggccgcgagcugaagugcggguccggcaucuucgucguggacaacgugcacaccuggaccgagcaguacaaguuccagcccgagagccccgcgcggcuggccagcgccauccucaacgcccacaaggacggcgucugcgggauccgcuccacgacccggcuggagaacgugauguggaagcagaucaccaacgagcugaacuacgugcucugggagggcgggcacgaccugaccgucguggccggcgacgugaagggcguccugacgaaggggaagcgcgcgcucaccccgcccgccagcgaccugaaguacuccuggaagaccuggggcaaggccaagaucuucacccccgaggcccggaacagcacguuccugaucgacgggcccgacaccuccgagugcccgaacgagcgccgggccuggaacagcuucgagguggaggacuacggcuucgggauguucaccaccaacaucuggaugaaguuccgcgagggcuccagcgaggugugcgaccaccggcucauguccgcggccaucaaggaccagaaggccguccacgccgacaugggcuacuggaucgagagcuccaagaaccagacguggcagaucgagcgcgcgagccugaucgaggugaagaccugccuguggcccaagacccacacccucugguccaacggggugcuggagagccagaugcugauccccaaguccuacgccggcccguucagccagcacaacuaccggcagggguacgccacccagacggucggccccuggcaccucgggaagcuggagaucgacuucggcgagugccccggcaccaccgugaccauccaggagaacugcgaccaccgcgggcccucccugcgcacgaccaccgccagcggcaagcucgugacccaguggugcugccggagcugcacgaugccgccccugcgcuuccugggggaggacggcugcugguacgggauggagauccggccccucuccgagaaggaggagaacauggucaagagccaggugaccgccggccagggcaccuccgagaccuucagcauggggcugcugugccucacgcuguucgucgaggagugccugcgccggcgcgugacccggaagcacaugauccucgcgguggucaucacccugugcgccaucauccugggcgggcucaccuggauggaccugcugcgcgcccucaucaugcugggcgacacgauguccggccgggucggcgggcagacccaccuggccaucaucgccguguucaagaugagccccggguacguccucgggguguuccugcgcaagcugaccucccgggagaccgcgcucauggugaucgggauggccaugacgaccacccugagcaucccgcacgaccugauggagcucaucgacggcaucucccugggccugauccuccugaagaucgucacccaguucgacaacacccagguggggacccuggcccucagccugaccuucauccgcuccaccaugagccuggugauggccuggcggacgaucauggccguccucuucguggugacccugaucccccugugccgcaccuccugccuccagaagcagagccacugggucgagaucaccgcgcugauccugggcgcccaggcccuccccguguaccugaugacgcugaugaagggggccucccggcgcagcuggccccucaacgagggcaucauggcgguggggcuggucucccugcucggcagcgcccugcugaagaacgacgugccgcucgccggccccaugguggccgggggccugcugcucgccgcguacgucauguccgggagcagcgccgaccugucccuggagaaggccgccaacgugcagugggacgagauggccgacaucaccggcagcucccccaucaucgaggugaagcaggacgaggacgggagcuucuccauccgggacgucgaggagaccaacaugaucacccuccuggugaagcuggcgcucaucacggugagcggccuguacccccuggccaucccgaucaccaugacccucugguacauguggcaggucaagacccagcgcuccggcgcccugugggacgugcccagccccgccgccacccagaaggcggcccuguccgaggggguguaccggaucaugcagcgcggccucuucgggaagacgcaggucggcguggggauccacauggagggcguguuccacaccauguggcacgucacccggggcagcgugaucugccacgagaccgggcgccuggagcccuccugggccgacgugcgcaacgacaugaucagcuacggcgggggcuggcggcugggcgacaagugggacaaggaggaggacguccaggugcucgccaucgagccggggaagaaccccaagcacgugcagacgaagcccggccuguucaagacccugaccggggagaucggcgccgucacccucgacuucaagcccgggacguccggcagcccgaucaucaaccgcaagggcaaggugaucgggcuguacggcaacgggguggucaccaaguccggcgacuacgugagcgcgaucacccaggccgagcggaucggggagcccgacuacgagguggacgaggacaucuuccgcaagaagcggcugaccaucauggaccuccaccccggcgccggcaagacgaagcgcauccugccguccaucguccgggaggcccugaagcgccggcugcgcacccucauccuggcgcccacccgggugguggccgccgagauggaggaggcccugcgcgggcuccccauccgguaccagacccccgccgucaagagcgagcacacgggccgcgagaucguggaccugaugugccacgcgaccuucaccacccggcugcucuccagcacgcgcgugccgaacuacaaccugaucgucauggacgaggcccacuucaccgaccccagcuccguggccgcccggggguacaucagcacccgcgucgagaugggcgaggccgcggccaucuucaugaccgccacgccgcccggggccaccgacccguucccccaguccaacagccccaucgaggacaucgagcgggagauccccgagcgcuccuggaacaccggcuucgacuggaucaccgacuaccagggcaagacggugugguucgugccgagcaucaaggccgggaacgacaucgcgaacugccugcgcaaguccggcaagaaggucauccagcucagccggaagaccuucgacaccgaguaccccaagaccaagcugacggacugggacuucguggugaccaccgacaucuccgagaugggggccaacuuccgcgccggccgggucaucgacccccgccggugccugaagcccgugauccucaccgacgggccggagcgcgugauccuggccggccccauccccgucacgcccgcgagcgccgcccagcggcgcggccggaucgggcgcaacccggcccaggaggacgaccaguacguguucuccggcgacccccugaagaacgacgaggaccacgcccacuggaccgaggcgaagaugcuccuggacaacaucuacacccccgaggggaucauccccacccuguucggcccggagcgggagaagacgcaggccaucgacggcgaguuccgccuccgcggggagcagcgcaagaccuucguggagcugaugcggcgcggcgaccugcccgucuggcucagcuacaagguggccuccgccgggaucagcuacaaggaccgggaguggugcuucaccggcgagcgcaacaaccagauccuggaggagaacauggagguggagaucuggacccgggagggggagaagaagaagcugcgccccaaguggcucgacgcccgggucuacgcggaccccauggcccugaaggacuucaaggaguucgccuccggccgcaagagcaucacccuggacauccucacggagaucgccucccugccgaccuaccugagcucccgcgccaagcucgcgcuggacaacaucgugaugcugcacaccaccgagcggggcgggcgcgccuaccagcacgcccucaacgagcugcccgagagccuggagacgcucaugcugguggcccugcucggcgcgaugaccgccgggaucuuccuguucuucaugcagggcaaggggaucggcaagcugagcaugggccucaucaccaucgccgucgccuccgggcugcuguggguggccgagauccagccccaguggaucgcggccagcaucauccucgaguucuuccugauggugcugcucaucccggagcccgagaagcagcggacgccccaggacaaccagcugaucuacgucauccugacgauccucaccaucaucggccugaucgccgccaacgagauggggcugaucgagaagaccaagaccgacuucggcuucuaccaggugaagacggagaccaccauccucgacguggaccugcgccccgccuccgcguggacccuguacgccgucgccacgaccauccucaccccgaugcugcggcacaccaucgagaacacgagcgccaaccugucccucgccgcgaucgccaaccaggccgccgugcugauggggcugggcaagggcuggccccuccaccgcauggaccugggggugccccugcucgccaugggcugcuacagccaggucaaccccaccacccugaccgcgucccuggugaugcuccuggugcacuacgccaucaucgggccgggccugcaggccaaggccacgcgggaggcgcagaagcgcaccgccgccggcaucaugaagaaccccaccgucgacgggaucaccgugaucgaccucgagcccaucagcuacgaccccaaguucgagaagcagcugggccaggugaugcugcucguccugugcgccgggcagcugcuccugaugcggacgaccugggccuucugcgaggugcugacccucgcgaccggcccgauccugacgcugugggaggggaaccccggccgcuucuggaacaccaccaucgccguguccaccgccaacaucuuccggggcagcuaccucgccggggccggccuggcguucucccugaucaagaacgcccagacgccccgccgggggaccggcaccgccggggagacccucggcgagaaguggaagcgccagcugaacagccuggaccggaaggaguucgaggaguacaagcgcuccggcauccucgaggucgaccggaccgaggccaagagcgcccugaaggacggguccaagaucaagcacgcggugagccgcggcuccagcaagauccgguggaucguggagcgcgggauggucaagcccaagggcaaggugguggaccuggggugcggccgcggcgggugguccuacuacauggccacgcucaagaacgucaccgaggugaagggcuacaccaagggcggcccggggcacgaggagcccauccccauggccaccuacggcuggaaccuggugaagcugcacagcggcgucgacguguucuacaagcccacggagcaggucgacacccuccugugcgacaucggggagagcuccagcaacccgaccaucgaggagggccggacccugcgcguccucaagaugguggagcccuggcuguccagcaagcccgaguucugcaucaaggugcugaaccccuacaugccgacggucaucgaggagcuggagaagcuccagcggaagcacgggggcaaccuggugcgcugcccccugucccggaacagcacccacgagauguacugggucuccggcgccagcgggaacaucguguccagcgugaacaccaccuccaagaugcuccugaaccgcuucacgacccggcaccgcaagcccaccuacgagaaggacgucgaccugggcgcggggacccggagcguguccacggagaucgagaagcccgacaugaccaucaucggccgccggcuccagcgccugcaggaggagcacaaggagaccuggcacuacgaccaggagaacccguaccggaccugggccuaccacgggagcuacgaggcccccuccacgggcagcgccuccagcauggugaacggcgucgugaagcugcucaccaagcccugggacgugaucccgauggucacccagcuggccaugaccgacacgacccccuucgggcagcagcgcguguucaaggagaagguggacacccggacgccccagcccaagccgggcacgcgcauggucaugaccaccaccgcgaacuggcugugggcccuccuggggaagaagaagaacccccggcugugcacgcgcgaggaguucaucuccaaggugcggagcaacgccgccaucggcgccguguuccaggaggagcagggguggaccagcgcguccgaggccgucaacgacagccgcuucugggagcucguggacaaggagcgggcccugcaccaggagggcaagugcgaguccugcguguacaacaugaugggcaagcgcgagaagaagcugggggaguucggccgcgccaaggggagccgggccaucugguacauguggcucggcgcgcgcuuccuggaguucgaggcccugggguuccucaacgaggaccacugguucggccgggagaacuccuggagcggcgucgagggggagggccugcaccgccugggguacauccucgaggagaucgacaagaaggacggcgaccugauguacgccgacgacaccgccggcugggacacccggaucacggaggacgaccugcagaacgaggagcucaucaccgagcagauggcgccccaccacaagauccuggccaaggccaucuucaagcugaccuaccagaacaagguggugaagguccuccgccccaccccgcgcggggccgugauggacaucaucucccgcaaggaccagcggggcagcggccaggugggcaccuacgggcugaacacguucaccaacauggagguccagcugauccgccagauggaggccgagggcgugaucacccaggacgacaugcagaaccccaagggccucaaggagcggguggagaaguggcugcgcgagugcggggucgaccggcugaagcgcauggcgaucuccggcgacgacugcguggugaagccccucgacgagcgguucgggaccagccugcuguuccucaacgacaugggcaagguccgcaaggacaucccccagugggagccguccaagggguggaagaacuggcaggaggugcccuucugcagccaccacuuccacaagaucuucaugaaggacggccggucccuggugguccccugccgcaaccaggacgagcugaucggccgggcccgcaucagccagggggccggcuggucccuccgcgagacggccugccuggggaaggccuacgcgcagauguggagccugauguacuuccaccggcgcgaccuccggcuggccuccauggccaucugcagcgccgugcccaccgagugguucccgaccagccgcaccacgugguccauccacgcccaccaccaguggaugaccaccgaggacaugcugaagguguggaaccgggucuggaucgaggacaaccccaacaugaucgacaagacccccgugcacagcugggaggacauccccuaccucggcaagcgcgaggaccuguggugcgggucccugaucggccucagcucccgggcgacgugggccaagaacauccacaccgccaucacccaggugcgcaaccugaucggcaaggaggaguacgucgacuacaugagcgugaugaagcgguacuccgccccgagcgaguccgagggggugcuguga

SEQ ID NO: 10508 - RNA, 9867 nt, Artificial Sequence
  derived and/or modified CDS sequence (opt1) from DENV-4__KJ579240__SS-prME
agcaccaucacccugcucugccugauccccacggugauggccuuccaccuguccacccgcgacggcgagccgcucaugaucgucgccaagcacgagcgggggcgcccccugcuguucaagaccaccgagggcaucaacaagugcacgcucaucgcgauggaccugggggagaugugcgaggacaccgugaccuacaagugcccccugcucgugaacaccgagcccgaggacaucgacugcuggugcaaccugacgagcaccugggucauguacggcaccugcacccaguccggggagcggcgccgggagaagcgcagcguggcccugacgccgcacuccggcaugggccucgagacccgggccgagaccuggaugagcuccgagggggccuggaagcacgcccagcgcguggagagcuggauccugcggaaccccggcuucgcgcugcucgccggguucauggccuacaugaucggccagaccgggauccagcgcacggucuucuucgugcugaugaugcugguggcccccuccuacggcaugcggugcgucggcguggggaaccgcgacuucguggagggcgucagcgggggcgcguggguggaccucgugcuggagcacggcgggugcgucaccaccauggcccagggcaagcccacccuggacuucgagcucacgaagaccaccgccaaggagguggcccugcugcggaccuacugcaucgaggcccucaucuccaacaucacgaccgcgacccgcugcccgacccagggggagcccuaccugaaggaggagcaggaccagcaguacaucugccggcgcgacguggucgaccggggcugggggaacggcugcggccuguucgggaagggcgggguggugacgugcgccaaguucagcugcuccggcaagaucaccgggaaccucguccagaucgagaaccuggaguacaccgugguggucaccgugcacaacggcgacacgcacgccgucggcaacgacaccagcaaccacggggugaccgccaccaucacgccccgcucccccagcguggaggucaagcugccggacuacggcgagcucacccuggacugcgagccccgguccgggaucgacuucaacgagaugauccugaugaagaugaagaagaagaccuggcucgugcacaagcagugguuccuggaccugccccuccccuggaccaccggcgccgacacgagcgaggugcacuggaacuacaaggagcgcauggucaccuucaaggugccgcacgcgaagcggcaggacgugaccguccuggggucccaggagggcgccaugcacagcgcccuggccggcgccaccgagguggacagcggggacggcaaccacauguucgcggggcaccucaagugcaaggugcgcauggagaagcugcgcaucaagggcauguccuacacgaugugcagcggcaaguucuccaucgacaaggagauggccgagacccagcacgggaccaccgucgugaaggugaaguacgagggcgccggggcccccugcaagguccccaucgagauccgggacgugaacaaggagaagguggucggccgcgugaucagcgccacgccccuggcggagaacaccaacuccgugaccaacaucgagcucgagccgcccuucggggacagcuacaucgucaucggcgugggcaacuccgcccugacccugcacugguuccggaaggggagcuccaucggcaagauguucgagagcacguaccgcggggccaagcggauggccauccucggcgagaccgcgugggacuucggguccgugggcggccuguucaccagccuggggaaggccguccaccagguguucggcuccguguacaccacgauguucgggggcgucagcuggaugauccgcauccucaucggguuccuggugcuguggaucggcaccaacucccggaacaccagcauggccgugaccugcaucgccgucggcgggaucacgcuguuccucggcuucaccgugcaggccgacauggggugcguggucuccuggagcggccgcgagcugaagugcggguccggcaucuucgugguggacaacguccacaccuggaccgagcaguacaaguuccagcccgagagccccgcgcggcuggccagcgccauccucaacgcccacaaggacggcgugugcgggauccgcuccacgacccggcuggagaacgugauguggaagcagaucaccaacgagcugaacuacguccucugggagggcgggcacgaccugaccgugguggccggcgacgucaagggcgugcugacgaaggggaagcgcgcgcucaccccgcccgccagcgaccugaaguacuccuggaagaccuggggcaaggccaagaucuucacccccgaggcccggaacagcacguuccugaucgacgggcccgacaccuccgagugcccgaacgagcgccgggccuggaacagcuucgagguggaggacuacggcuucgggauguucaccaccaacaucuggaugaaguuccgcgagggcuccagcgaggucugcgaccaccggcucauguccgcggccaucaaggaccagaaggccgugcacgccgacaugggcuacuggaucgagagcuccaagaaccagacguggcagaucgagcgcgcgagccugaucgaggugaagaccugccuguggcccaagacccacacccucugguccaacgggguccuggagagccagaugcugauccccaaguccuacgccggcccguucagccagcacaacuaccggcagggguacgccacccagacggugggccccuggcaccucgggaagcuggagaucgacuucggcgagugccccggcaccaccgugaccauccaggagaacugcgaccaccgcgggcccucccugcgcacgaccaccgccagcggcaagcucgucacccaguggugcugccggagcugcacgaugccgccccugcgcuuccugggggaggacggcugcugguacgggauggagauccggccccucuccgagaaggaggagaacauggugaagagccaggucaccgccggccagggcaccuccgagaccuucagcauggggcugcugugccucacgcuguucguggaggagugccugcgccggcgcgugacccggaagcacaugauccucgcggucgugaucacccugugcgccaucauccugggcgggcucaccuggauggaccugcugcgcgcccucaucaugcugggcgacacgauguccggccggaucgggggccagacccaccuggccaucaucgccguguucaagaugagccccggguacguccucggcguguuccugcgcaagcugaccucccgggagaccgcgcucauggugaucgggauggccaugacgaccacccugagcaucccgcacgaccugauggagcucaucgacggcaucucccugggccugauccuccugaagaucgucacccaguucgacaacacgcagguggggacccuggcccucagccugaccuucauccgcuccaccaugagccuggugauggccuggcggacgaucauggccguccucuucguggugacccugaucccccugugccgcaccuccugccuccagaagcagagccacugggucgagaucaccgcgcugauccugggcgcccaggcccuccccguguaccugaugacgcugaugaagggggccucccggcgcagcuggccccucaacgagggcaucauggcgguggggcuggucucccugcucggcagcgcccugcugaagaacgacgugccgcucgccggccccaugguggccgggggccugcugcucgccgcguacgucauguccgggagcagcgccgaccugucccuggagaaggccgccaacgugcagugggacgagauggccgacaucaccggcagcucccccaucaucgaggugaagcaggacgaggacgggagcuucuccauccgggacgucgaggagaccaacaugaucacccuccuggugaagcuggcgcucaucacggugagcggccuguacccccuggccaucccgaucaccaugacccucugguacauguggcaggucaagacccagcgcuccggcgcccugugggacgugcccagccccgccgccacccagaaggcggcccuguccgaggggguguaccggaucaugcagcgcggccucuucgggaagacgcaggucggcguggggauccacauggagggcguguuccacaccauguggcacgucacccggggcagcgugaucugccacgagaccgggcgccuggagcccuccugggccgacgugcgcaacgacaugaucagcuacggcgggggcuggcggcugggcgacaagugggacaaggaggaggacguccaggugcucgccaucgagccggggaagaaccccaagcacgugcagacgaagcccggccuguucaagacccugaccggggagaucggcgccgucacccucgacuucaagcccgggacguccggcagcccgaucaucaaccgcaagggcaaggugaucgggcuguacggcaacgggguggucaccaaguccggcgacuacgugagcgcgaucacccaggccgagcggaucggggagcccgacuacgagguggacgaggacaucuuccgcaagaagcggcugaccaucauggaccuccaccccggcgccggcaagacgaagcgcauccugccguccaucguccgggaggcccugaagcgccggcugcgcacccucauccuggcgcccacccgggugguggccgccgagauggaggaggcccugcgcgggcuccccauccgguaccagacccccgccgucaagagcgagcacacgggccgcgagaucguggaccugaugugccacgcgaccuucaccacccggcugcucuccagcacgcgcgugccgaacuacaaccugaucgucauggacgaggcccacuucaccgaccccagcuccguggccgcccggggguacaucagcacccgcgucgagaugggcgaggccgcggccaucuucaugaccgccacgccccccggggccaccgacccguucccccaguccaacagccccaucgaggacaucgagcgggagauccccgagcgcuccuggaacaccggcuucgacuggaucaccgacuaccagggcaagacggugugguucgugccgagcaucaaggccgggaacgacaucgcgaacugccugcgcaaguccggcaagaaggucauccagcucagccggaagaccuucgacaccgaguaccccaagaccaagcugacggacugggacuucguggugaccaccgacaucuccgagaugggggccaacuuccgcgccggccgggucaucgacccccgccggugccugaagcccgugauccucaccgacgggccggagcgcgugauccuggccggccccauccccgucacgcccgcgagcgccgcccagcggcgcggccggaucgggcgcaacccggcccaggaggacgaccaguacguguucuccggcgacccccugaagaacgacgaggaccacgcccacuggaccgaggcgaagaugcuccuggacaacaucuacacccccgaggggaucauccccacccuguucggcccggagcgggagaagacgcaggccaucgacggcgaguuccgccuccggggggagcagcgcaagaccuucguggagcugaugcggcgcggcgaccugcccgucuggcucagcuacaagguggccuccgccgggaucagcuacaaggaccgggaguggugcuucaccggcgagcgcaacaaccagauccuggaggagaacauggagguggagaucuggacccgggagggggagaagaagaagcugcgccccaaguggcucgacgcccgggucuacgcggaccccauggcccugaaggacuucaaggaguucgccuccggccgcaagagcaucacccuggacauccucacggagaucgccucccugccgaccuaccugagcucccgcgccaagcucgcgcuggacaacaucgugaugcugcacaccaccgagcggggcgggcgcgccuaccagcacgcccucaacgagcugcccgagagccuggagacgcucaugcugguggcccugcucggcgcgaugaccgccgggaucuuccuguucuucaugcagggcaaggggaucggcaagcugagcaugggccucaucaccaucgccgucgccuccgggcugcuguggguggccgagauccagccccaguggaucgcggccagcaucauccucgaguucuuccugauggugcugcucaucccggagcccgagaagcagcggaccccccaggacaaccagcugaucuacgucauccugacgauccucaccaucaucggccugaucgccgccaacgagauggggcugaucgagaagaccaagaccgacuucggcuucuaccaggugaagacggagaccaccauccucgacguggaccugcgccccgccuccgcguggacccuguacgccgucgccacgaccauccucaccccgaugcugcggcacaccaucgagaacacgagcgccaaccugucccucgccgcgaucgccaaccaggccgccgugcugauggggcugggcaagggcuggccccuccaccgcauggaccugggggugccccugcucgccaugggcugcuacagccaggucaaccccaccacccugaccgcgucccuggugaugcuccuggugcacuacgccaucaucgggccgggccugcaggccaaggccacgcgggaggcgcagaagcgcaccgccgccggcaucaugaagaaccccaccgucgacgggaucaccgugaucgaccucgagcccaucagcuacgaccccaaguucgagaagcagcugggccaggugaugcugcucguccugugcgccgggcagcugcuccugaugcggacgaccugggccuucugcgaggugcugacccucgcgaccggcccgauccugacgcugugggaggggaaccccggccgcuucuggaacaccaccaucgccguguccaccgccaacaucuuccggggcagcuaccucgccggggccggccuggcguucucccugaucaagaacgcccagacgccccgccgggggaccggcaccgccggggagacccucggcgagaaguggaagcgccagcugaacagccuggaccggaaggaguucgaggaguacaagcgcuccggcauccucgaggucgaccggaccgaggccaagagcgcccugaaggacggguccaagaucaagcacgcggugagccgcggcuccagcaagauccgguggaucguggagcgcgggauggucaagcccaagggcaaggugguggaccuggggugcggccgcggcgggugguccuacuacauggccacgcucaagaacgucaccgaggugaagggcuacaccaaggggggcccggggcacgaggagcccauccccauggccaccuacggcuggaaccuggugaagcugcacagcggcgucgacguguucuacaagcccacggagcagguggacacccuccugugcgacaucggggagagcuccagcaacccgaccaucgaggagggccggacccugcgcguccucaagaugguggagcccuggcuguccagcaagcccgaguucugcaucaaggugcugaaccccuacaugccgacggucaucgaggagcuggagaagcuccagcggaagcacgggggcaaccuggugcgcugcccccugucccggaacagcacccacgagauguacugggucuccggcgccagcgggaacaucguguccagcgugaacaccaccuccaagaugcuccugaaccgcuucacgacccggcaccgcaagcccaccuacgagaaggacgucgaccugggcgcggggacccggagcguguccacggagaucgagaagcccgacaugaccaucaucggccgccggcuccagcgccugcaggaggagcacaaggagaccuggcacuacgaccaggagaacccguaccggaccugggccuaccacgggagcuacgaggcccccuccacgggcagcgccuccagcauggugaacggcgucgugaagcugcucaccaagcccugggacgugaucccgauggucacccagcuggccaugaccgacacgacccccuucgggcagcagcgcguguucaaggagaagguggacacccggaccccccagcccaagccgggcacgcgcauggucaugaccaccaccgcgaacuggcugugggcccuccuggggaagaagaagaacccccggcugugcacgcgcgaggaguucaucuccaaggugcggagcaacgccgccaucggcgccguguuccaggaggagcagggguggaccagcgcguccgaggccgucaacgacagccgcuucugggagcucguggacaaggagcgggcccugcaccaggagggcaagugcgaguccugcguguacaacaugaugggcaagcgcgagaagaagcugggggaguucggccgcgccaaggggagccgggccaucugguacauguggcucggcgcgcgcuuccuggaguucgaggcccugggguuccucaacgaggaccacugguucggccgggagaacuccuggagcggcgucgagggggagggccugcaccgccugggguacauccucgaggagaucgacaagaaggacggcgaccugauguacgccgacgacaccgccggcugggacacccggaucacggaggacgaccugcagaacgaggagcucaucaccgagcagauggcgccccaccacaagauccuggccaaggccaucuucaagcugaccuaccagaacaagguggugaagguccuccgccccaccccgcggggggccgugauggacaucaucucccgcaaggaccagcggggcagcgggcaggugggcaccuacgggcugaacacguucaccaacauggagguccagcugauccgccagauggaggccgagggcgugaucacccaggacgacaugcagaaccccaagggccucaaggagcggguggagaaguggcugcgcgagugcggggucgaccggcugaagcgcauggcgaucuccggcgacgacugcguggugaagccccucgacgagcgguucgggaccagccugcuguuccucaacgacaugggcaagguccgcaaggacaucccccagugggagccguccaagggguggaagaacuggcaggaggugcccuucugcagccaccacuuccacaagaucuucaugaaggacggccggucccuggugguccccugccgcaaccaggacgagcugaucggccgggcccgcaucagccagggggccggcuggucccuccgcgagacggccugccuggggaaggccuacgcgcagauguggagccugauguacuuccaccggcgcgaccuccggcuggccuccauggccaucugcagcgccgugcccaccgagugguucccgaccagccgcaccacgugguccauccacgcccaccaccaguggaugaccaccgaggacaugcugaagguguggaaccgggucuggaucgaggacaaccccaacaugaucgacaagacccccgugcacagcugggaggacauccccuaccucggcaagcgcgaggaccuguggugcgggucccugaucggccucagcucccgggcgacgugggccaagaacauccacaccgccaucacccaggugcgcaaccugaucggcaaggaggaguacgucgacuacaugagcgugaugaagcgguacuccgccccgagcgaguccgagggggugcuguga

SEQ ID NO: 10509 - RNA, 9867 nt, Artificial Sequence
  derived and/or modified CDS sequence (opt1) from DENV-4__KJ596658__SS-prME
agcaccaucacccugcucugccugauccccacggugauggccuuccaccuguccacccgcgacggcgagccgcucaugaucgucgccaagcacgagcgggggcgcccccugcuguucaagaccaccgagggcaucaacaagugcacgcucaucgcgauggaccugggggagaugugcgaggacaccgugaccuacaagugcccccugcucgugaacaccgagcccgaggacaucgacugcuggugcaaccugacgagcaccugggucauguacggcaccugcacccaguccggggagcggcgccgggagaagcgcagcguggcccugacgccgcacuccggcaugggccucgagacccgggccgagaccuggaugagcuccgagggggccuggaagcacgcccagcgcguggagagcuggauccugcggaaccccggcuucgcgcugcucgccggguucauggccuacaugaucggccagaccgggauccagcgcacggucuucuucgugcugaugaugcugguggcccccuccuacggcaugcggugcgucggcguggggaaccgcgacuucguggagggcgucagcgggggcgcguggguggaccucgugcuggagcacggcgggugcgucaccaccauggcccagggcaagcccacccuggacuucgagcucacgaagaccaccgccaaggagguggcccugcugcggaccuacugcaucgaggcccucaucuccaacaucacgaccgcgacccgcugcccgacccagggggagcccuaccugaaggaggagcaggaccagcaguacaucugccggcgcgacguggucgaccggggcugggggaacggcugcggccuguucgggaagggcgggguggugacgugcgccaaguucagcugcuccggcaagaucaccgggaaccucguccagaucgagaaccuggaguacaccgugguggucaccgugcacaacggcgacacgcacgccgucggcaacgacaccagcaaccacggggugaccgccaccaucacgccccgcucccccagcguggaggucaagcugccggacuacggcgagcucacccuggacugcgagccccgguccgggaucgacuucaacgagaugauccugaugaagaugaagaagaagaccuggcucgugcacaagcagugguuccuggaccugccccuccccuggaccaccggcgccgacacgagcgaggugcacuggaacuacaaggagcgcauggucaccuucaaggugccgcacgcgaagcggcaggacgugaccguccuggggucccaggagggcgccaugcacagcgcccuggccggcgccaccgagguggacagcggggacggcaaccacauguucgcggggcaccucaagugcaaggugcgcauggagaagcugcgcaucaagggcauguccuacacgaugugcagcggcaaguucuccaucgacaaggagauggccgagacccagcacgggaccaccgucgugaaggugaaguacgagggcgccggggcccccugcaagguccccaucgagauccgggacgugaacaaggagaagguggucggccgcgugaucagcgccacgccccuggcggagaacaccaacuccgugaccaacaucgagcucgagccgcccuucggggacagcuacaucgucaucggcgugggcaacuccgcccugacccugcacugguuccggaaggggagcuccaucggcaagauguucgagagcacguaccgcggggccaagcggauggccauccucggcgagaccgcgugggacuucggguccgugggcggccuguucaccagccuggggaaggccguccaccagguguucggcuccguguacaccacgauguucgggggcgucagcuggaugauccgcauccucaucggguuccuggugcuguggaucggcaccaacucccggaacaccagcauggccaugaccugcaucgccgugggcgggaucacgcuguuccucggcuucaccguccaggccgacauggggugcgugguguccuggagcggccgcgagcugaagugcggguccggcaucuucgucguggacaacgugcacaccuggaccgagcaguacaaguuccagcccgagagccccgcgcggcuggccagcgccauccucaacgcccacaaggacggcgucugcgggauccgcuccacgacccggcuggagaacgugauguggaagcagaucaccaacgagcugaacuacgugcucugggagggcgggcacgaccugaccgucguggccggcgacgugaagggcguccugacgaaggggaagcgcgcgcucaccccgcccgccagcgaccugaaguacuccuggaagaccuggggcaaggccaagaucuucacccccgaggcccggaacagcacguuccugaucgacgggcccgacaccuccgagugcccgaacgagcgccgggccuggaacagcuucgagguggaggacuacggcuucgggauguucaccaccaacaucuggaugaaguuccgcgagggcuccagcgaggugugcgaccaccggcucauguccgcggccaucaaggaccagaaggccguccacgccgacaugggcuacuggaucgagagcuccaagaaccagacguggcagaucgagcgcgcgagccugaucgaggugaagaccugccuguggcccaagacccacacccucugguccaacggggugcuggagagccagaugcugauccccaaguccuacgccggcccguucagccagcacaacuaccggcagggguacgccacccagacggucggccccuggcaccucgggaagcuggagaucgacuucggcgagugccccggcaccaccgugaccauccaggagaacugcgaccaccgcgggcccucccugcgcacgaccaccgccagcggcaagcucgugacccaguggugcugccggagcugcacgaugccgccccugcgcuuccugggggaggacggcugcugguacgggauggagauccggccccucuccgagaaggaggagaacauggucaagagccaggugaccgccggccagggcaccuccgagaccuucagcauggggcugcugugccucacgcuguucgucgaggagugccugcgccggcgcgugacccggaagcacaugauccucgcgguggucaucacccugugcgccaucauccugggcgggcucaccuggauggaccugcugcgcgcccucaucauccugggcgacacgauguccggccggaucgggggccagacccaccuggccaucauggccguguucaagaugagccccggguacgugcucggcgucuuccugcgcaagcugaccucccgggagaccgcgcucauggugaucgggauggccaugacgaccacccugagcaucccgcacgaccugauggagcucaucgacggcaucucccugggccugauccuccugaagaucgugacccaguucgacaacacgcaggucgggacccuggcccucagccugaccuucauccgcuccaccaugagccuggugauggccuggcggacgaucauggccgugcucuucgucgugacccugaucccccugugccgcaccuccugccuccagaagcagagccacuggguggagaucaccgcgcugauccugggcgcccaggcccuccccgucuaccugaugacgcugaugaagggggccucccggcgcagcuggccccucaacgagggcaucauggcgguggggcuggugucccugcucggcagcgcccugcugaagaacgacgucccgcucgccggccccaugguggccgggggccugcugcucgccgcguacgugauguccgggagcagcgccgaccugucccuggagaaggccgccaacguccagugggacgagauggccgacaucaccggcagcucccccaucaucgaggugaagcaggacgaggacgggagcuucuccauccgggacguggaggagaccaacaugaucacccuccuggucaagcuggcgcucaucacggugagcggccuguacccccuggccaucccgaucaccaugacccucugguacauguggcaggugaagacccagcgcuccggcgcccugugggacguccccagccccgccgccacccagaaggcggcccuguccgaggggguguaccggaucaugcagcgcggccucuucgggaagacgcaggugggcgucgggauccacauggagggcguguuccacaccauguggcacgugacccggggcagcgucaucugccacgagaccgggcgccuggagcccuccugggccgacgugcgcaacgacaugaucagcuacggcgggggcuggcggcugggcgacaagugggacaaggaggaggacgugcagguccucgccaucgagccggggaagaaccccaagcacgugcagacgaagcccggccuguucaagacccugaccggggagaucggcgccgugacccucgacuucaagcccgggacguccggcagcccgaucaucaaccgcaagggcaaggucaucgggcuguacggcaacgggguggugaccaaguccggcgacuacgucagcgcgaucacccaggccgagcggaucggggagcccgacuacgagguggacgaggacaucuuccgcaagaagcggcugaccaucauggaccuccaccccggcgccggcaagacgaagcgcauccugccguccaucgugcgggaggcccugaagcgccggcugcgcacccucauccuggcgcccacccgggucguggccgccgagauggaggaggcccugcgcgggcuccccauccgguaccagacccccgccgugaagagcgagcacacgggccgcgagaucgucgaccugaugugccacgcgaccuucaccacccggcugcucuccagcacgcgcgugccgaacuacaaccugaucgugauggacgaggcccacuucaccgaccccagcuccgucgccgcccggggguacaucagcacccgcguggagaugggcgaggccgcggccaucuucaugaccgccacgccccccggggccaccgacccguucccccaguccaacagccccaucgaggacaucgagcgggagauccccgagcgcuccuggaacaccggcuucgacuggaucaccgacuaccagggcaagacggucugguucgugccgagcaucaaggccgggaacgacaucgcgaacugccugcgcaaguccggcaagaaggugauccagcucagccggaagaccuucgacaccgaguaccccaagaccaagcugacggacugggacuucgucgugaccaccgacaucuccgagaugggggccaacuuccgcgccggccgggugaucgacccccgccggugccugaagcccgucauccucaccgacgggccggagcgcgugauccuggccggccccauccccgugacgcccgcgagcgccgcccagcggcgcggccggaucgggcgcaacccggcccaggaggacgaccaguacgucuucuccggcgacccccugaagaacgacgaggaccacgcccacuggaccgaggcgaagaugcuccuggacaacaucuacacccccgaggggaucauccccacccuguucggcccggagcgggagaagacgcaggccaucgacggcgaguuccgccuccggggggagcagcgcaagaccuucguggagcugaugcggcgcggcgaccugcccguguggcucagcuacaaggucgccuccgccgggaucagcuacaaggaccgggaguggugcuucaccggcgagcgcaacaaccagauccuggaggagaacauggagguggagaucuggacccgggagggggagaagaagaagcugcgccccaaguggcucgacgcccggguguacgcggaccccauggcccugaaggacuucaaggaguucgccuccggccgcaagagcaucacccuggacauccucacggagaucgccucccugccgaccuaccugagcucccgcgccaagcucgcgcuggacaacaucgucaugcugcacaccaccgagcggggcgggcgcgccuaccagcacgcccucaacgagcugcccgagagccuggagacgcucaugcugguggcccugcucggcgcgaugaccgccgggaucuuccuguucuucaugcagggcaaggggaucggcaagcugagcaugggccucaucaccaucgccguggccuccgggcugcugugggucgccgagauccagccccaguggaucgcggccagcaucauccucgaguucuuccugauggugcugcucaucccggagcccgagaagcagcggaccccccaggacaaccagcugaucuacgugauccugacgauccucaccaucaucggccugaucgccgccaacgagauggggcugaucgagaagaccaagaccgacuucggcuucuaccaggucaagacggagaccaccauccucgacguggaccugcgccccgccuccgcguggacccuguacgccguggccacgaccauccucaccccgaugcugcggcacaccaucgagaacacgagcgccaaccugucccucgccgcgaucgccaaccaggccgccguccugauggggcugggcaagggcuggccccuccaccgcauggaccugggggugccccugcucgccaugggcugcuacagccaggugaaccccaccacccugaccgcgucccuggucaugcuccuggugcacuacgccaucaucgggccgggccugcaggccaaggccacgcgggaggcgcagaagcgcaccgccgccggcaucaugaagaaccccaccguggacgggaucaccgucaucgaccucgagcccaucagcuacgaccccaaguucgagaagcagcugggccaggugaugcugcucgugcugugcgccgggcagcugcuccugaugcggacgaccugggccuucugcgagguccugacccucgcgaccggcccgauccugacgcugugggaggggaaccccggccgcuucuggaacaccaccaucgccguguccaccgccaacaucuuccggggcagcuaccucgccggggccggccuggcguucucccugaucaagaacgcccagacgccccgccgggggaccggcaccgccggggagacccucggcgagaaguggaagcgccagcugaacagccuggaccggaaggaguucgaggaguacaagcgcuccggcauccucgagguggaccggaccgaggccaagagcgcccugaaggacggguccaagaucaagcacgcggucagccgcggcuccagcaagauccgguggaucguggagcgcgggauggugaagcccaagggcaaggucguggaccuggggugcggccgcggcgggugguccuacuacauggccacgcucaagaacgugaccgaggucaagggcuacaccaaggggggcccggggcacgaggagcccauccccauggccaccuacggcuggaaccuggugaagcugcacagcggcguggacgucuucuacaagcccacggagcagguggacacccuccugugcgacaucggggagagcuccagcaacccgaccaucgaggagggccggacccugcgcgugcucaagauggucgagcccuggcuguccagcaagcccgaguucugcaucaaggugcugaaccccuacaugccgacggugaucgaggagcuggagaagcuccagcggaagcacgggggcaaccugguccgcugcccccugucccggaacagcacccacgagauguacuggguguccggcgccagcgggaacaucgucuccagcgugaacaccaccuccaagaugcuccugaaccgcuucacgacccggcaccgcaagcccaccuacgagaaggacguggaccugggcgcggggacccggagcgucuccacggagaccgagaagcccgacaugaccaucaucggccgccggcuccagcgccugcaggaggagcacaaggagaccuggcacuacgaccaggagaacccguaccggacgugggccuaccacgggagcuacgaggcccccuccaccggcagcgccuccagcauggugaacggcguggucaagcugcucaccaagcccugggacgugaucccgauggugacccagcuggccaugacggacaccacccccuucgggcagcagcgcgucuucaaggagaagguggacacccggacgccccagcccaagccgggcacccgcauggugaugaccaccacggcgaacuggcugugggcccuccuggggaagaagaagaacccccggcugugcacccgcgaggaguucaucuccaagguccggagcaacgccgccaucggcgccguguuccaggaggagcagggguggaccagcgcguccgaggccgugaacgacagccgcuucugggagcucgucgacaaggagcgggcccugcaccaggagggcaagugcgaguccugcguguacaacaugaugggcaagcgcgagaagaagcugggggaguucggccgcgccaaggggagccgggccaucugguacauguggcucggcgcgcgcuuccuggaguucgaggcccugggguuccucaacgaggaccacugguucggccgggagaacuccuggagcggcguggagggggagggccugcaccgccugggguacauccucgaggagaucgacaagaaggacggcgaccugauguacgccgacgacaccgccggcugggacacgcggaucaccgaggacgaccugcagaacgaggagcucaucaccgagcagauggcgccccaccacaagauccuggccaaggccaucuucaagcugaccuaccagaacaaggucgugaaggugcuccgccccaccccgcggggggccgucauggacaucaucucccgcaaggaccagcggggcagcgggcaggugggcacguacgggcugaacaccuucaccaacauggaggugcagcugauccgccagauggaggccgagggcgucaucacccaggacgacaugcagaaccccaagggccucaaggagcggguggagaaguggcugcgcgagugcgggguggaccggcugaagcgcauggcgaucuccggcgacgacugcgucgugaagccccucgacgagcgguucgggacgagccugcuguuccucaacgacaugggcaaggugcgcaaggacaucccccagugggagccguccaagggguggaagaacuggcaggagguccccuucugcagccaccacuuccacaagaucuucaugaaggacggccggucccugguggugcccugccgcaaccaggacgagcugaucggccgggcccgcaucagccagggggccggcuggucccuccgcgagaccgccugccuggggaaggccuacgcgcagauguggagccugauguacuuccaccggcgcgaccuccggcuggccuccauggccaucugcagcgccguccccaccgagugguucccgaccagccgcacgaccugguccauccacgcccaccaccaguggaugaccaccgaggacaugcugaagguguggaaccggguguggaucgaggacaaccccaacaugaucgacaagacgcccguccacagcugggaggacauccccuaccucggcaagcgcgaggaccuguggugcgggucccugaucggccucagcucccgggcgaccugggccaagaacauccacaccgccaucacccaggugcgcaaccugaucggcaaggaggaguacguggacuacaugccggucaugaagcgguacagcgcccccuccgagagcgagggggugcuguga

SEQ ID NO: 10510 - RNA, 9867 nt, Artificial Sequence
  derived and/or modified CDS sequence (opt1) from DENV-4__KJ596659__SS-prME
agcaccaucacccugcucugccugauccccacggugauggccuuccaccuguccacccgcgacggcgagccgcucaugaucgucgccaagcacgagcgggggcgcccccugcuguucaagaccaccgagggcaucaacaagugcacgcucaucgcgauggaccugggggagaugugcgaggacaccgugaccuacaagugcccccugcucgugaacaccgagcccgaggacaucgacugcuggugcaaccugacgagcaccugggucauguacggcaccugcacccaguccggggagcggcgccgggagaagcgcagcguggcccugacgccgcacuccggcaugggccucgagacccgggccgagaccuggaugagcuccgagggggccuggaagcacgcccagcgcguggagagcuggauccugcggaaccccggcuucgcgcugcucgccggguucauggccuacaugaucggccagaccgggauccagcgcacggucuucuucgugcugaugaugcugguggcccccuccuacggcaugcggugcgucggcguggggaaccgcgacuucguggagggcgucagcgggggcgcguggguggaccucgugcuggagcacggcgggugcgucaccaccauggcccagggcaagcccacccuggacuucgagcucacgaagaccaccgccaaggagguggcccugcugcggaccuacugcaucgaggcccucaucuccaacaucacgaccgcgacccgcugcccgacccagggggagcccuaccugaaggaggagcaggaccagcaguacaucugccggcgcgacguggucgaccggggcugggggaacggcugcggccuguucgggaagggcgggguggugacgugcgccaaguucagcugcuccggcaagaucaccgggaaccucguccagaucgagaaccuggaguacaccgugguggucaccgugcacaacggcgacacgcacgccgucggcaacgacaccagcaaccacggggugaccgccaccaucacgccccgcucccccagcguggaggucaagcugccggacuacggcgagcucacccuggacugcgagccccgguccgggaucgacuucaacgagaugauccugaugaagaugaagaagaagaccuggcucgugcacaagcagugguuccuggaccugccccuccccuggaccaccggcgccgacacgagcgaggugcacuggaaccacaaggagcgcauggucaccuucaaggugccgcacgcgaagcggcaggacgugaccguccuggggucccaggagggcgccaugcacagcgcccuggccggcgccaccgagguggacagcggggacggcaaccacauguucgcggggcaccucaagugcaaggugcgcauggagaagcugcgcaucaagggcauguccuacacgaugugcagcggcaaguucuccaucgacaaggagauggccgagacccagcacgggaccaccgucgugaaggugaaguacgagggcgccggggcccccugcaagguccccaucgagauccgggacgugaacaaggagaagguggucggccgcgugaucagcgccacgccccuggcggagaacaccaacuccgugaccaacaucgagcucgagccgcccuucggggacagcuacaucgucaucggcgugggcaacuccgcccugacccugcacugguuccggaaggggagcuccaucggcaagauguucgagagcacguaccgcggggccaagcggauggccauccucggcgagaccgcgugggacuucggguccgugggcggccuguucaccagccuggggaaggccguccaccagguguucggcuccguguacaccacgauguucgggggcgucagcuggaugauccgcauccucaucggguuccuggugcuguggaucggcaccaacucccggaacaccagcauggccaugaccugcaucgccgugggcgggaucacgcuguuccucggcuucaccguccaggccgacauggggugcgugguguccuggagcggccgcgagcugaagugcggguccggcaucuucgucguggacaacgugcacaccuggaccgagcaguacaaguuccagcccgagagccccgcgcggcuggccagcgccauccucaacgcccacaaggacggcgucugcgggauccgcuccacgacccggcuggagaacgugauguggaagcagaucaccaacgagcugaacuacgugcucugggagggcgggcacgaccugaccgucguggccggcgacgugaagggcguccugacgaaggggaagcgcgcgcucaccccgcccgccagcgaccugaaguacuccuggaagaccuggggcaaggccaagaucuucacccccgaggcccggaacagcacguuccugaucgacgggcccgacaccuccgagugcccgaacgagcgccgggccuggaacagcuucgagguggaggacuacggcuucgggauguucaccaccaacaucuggaugaaguuccgcgagggcuccagcgaggugugcgaccaccggcucauguccgcggccaucaaggaccagaaggccguccacgccgacaugggcuacuggaucgagagcuccaagaaccagacguggcagaucgagcgcgcgagccugaucgaggugaagaccugccuguggcccaagacccacacccucugguccaacggggugcuggagagccagaugcugauccccaaguccuacgccggcccguucagccagcacaacuaccggcagggguacgccacccagacggucggccccuggcaccucgggaagcuggagaucgacuucggcgagugccccggcaccaccgugaccauccaggagaacugcgaccaccgcgggcccucccugcgcacgaccaccgccagcggcaagcucgugacccaguggugcugccggagcugcacgaugccgccccugcgcuuccugggggaggacggcugcugguacgggauggagauccggccccucuccgagaaggaggagaacauggucaagagccaggugaccgccggccagggcaccuccgagaccuucagcauggggcugcugugccucacgcuguucgucgaggagugccugcgccggcgcgugacccggaagcacaugauccucgcgguggucaucacccugugcgccaucauccugggcgggcucaccuggauggaccugcugcgcgcccucaucauccugggcgacacgauguccggccggaucgggggccagacccaccuggccaucauggccguguucaagaugagccccggguacgugcucggcgucuuccugcgcaagcugaccucccgggagaccgcgcucauggugaucgggauggccaugacgaccacccugagcaucccgcacgaccugauggagcucaucgacggcaucucccugggccugauccuccugaagaucgugacccaguucgacaacacgcaggucgggacccuggcccucagccugaccuucauccgcuccaccaugagccuggugauggccuggcggacgaucauggccgugcucuucgucgugacccugaucccccugugccgcaccuccugccuccagaagcagagccacuggguggagaucaccgcgcugauccugggcgcccaggcccuccccgucuaccugaugacgcugaugaagggggccucccggcgcagcuggccccucaacgagggcaucauggcgguggggcuggugucccugcucggcagcgcccugcugaagaacgacgucccgcucgccggccccaugguggccgggggccugcugcucgccgcguacgugauguccgggagcagcgccgaccugucccuggagaaggccgccaacguccagugggacgagauggccgacaucaccggcagcucccccaucaucgaggugaagcaggacgaggacgggagcuucuccauccgggacguggaggagaccaacaugaucacccuccuggucaagcuggcgcucaucacggugagcggccuguacccccuggccaucccgaucaccaugacccucugguacauguggcaggugaagacccagcgcuccggcgcccugugggacguccccagccccgccgccacccagaaggcggcccuguccgaggggguguaccggaucaugcagcgcggccucuucgggaagacgcaggugggcgucgggauccacauggagggcguguuccacaccauguggcacgugacccggggcagcgucaucugccacgagaccgggcgccuggagcccuccugggccgacgugcgcaacgacaugaucagcuacggcgggggcuggcggcugggcgacaagugggacaaggaggaggacgugcagguccucgccaucgagccggggaagaaccccaagcacgugcagacgaagcccggccuguucaagacccugaccggggagaucggcgccgugacccucgacuucaagcccgggacguccggcagcccgaucaucaaccgcaagggcaaggucaucgggcuguacggcaacgggguggugaccaaguccggcgacuacgucagcgcgaucacccaggccgagcggaucggggagcccgacuacgagguggacgaggacaucuuccgcaagaagcggcugaccaucauggaccuccaccccggcgccggcaagacgaagcgcauccugccguccaucgugcgggaggcccugaagcgccggcugcgcacccucauccuggcgcccacccgggucguggccgccgagauggaggaggcccugcgcgggcuccccauccgguaccagacccccgccgugaagagcgagcacacgggccgcgagaucgucgaccugaugugccacgcgaccuucaccacccggcugcucuccagcacgcgcgugccgaacuacaaccugaucgugauggacgaggcccacuucaccgaccccagcuccgucgccgcccggggguacaucagcacccgcguggagaugggcgaggccgcggccaucuucaugaccgccacgccccccggggccaccgacccguucccccaguccaacagccccaucgaggacaucgagcgggagauccccgagcgcuccuggaacaccggcuucgacuggaucaccgacuaccagggcaagacggucugguucgugccgagcaucaaggccgggaacgacaucgcgaacugccugcgcaaguccggcaagaaggugauccagcucagccggaagaccuucgacaccgaguaccccaagaccaagcugacggacugggacuucgucgugaccaccgacaucuccgagaugggggccaacuuccgcgccggccgggugaucgacccccgccggugccugaagcccgucauccucaccgacgggccggagcgcgugauccuggccggccccauccccgugacgcccgcgagcgccgcccagcggcgcggccggaucgggcgcaacccggcccaggaggacgaccaguacgucuucuccggcgacccccugaagaacgacgaggaccacgcccacuggaccgaggcgaagaugcuccuggacaacaucuacacccccgaggggaucauccccacccuguucggcccggagcgggagaagacgcaggccaucgacggcgaguuccgccuccggggggagcagcgcaagaccuucguggagcugaugcggcgcggcgaccugcccguguggcucagcuacaaggucgccuccgccgggaucagcuacaaggaccgggaguggugcuucaccggcgagcgcaacaaccagauccuggaggagaacauggagguggagaucuggacccgggagggggagaagaagaagcugcgccccaaguggcucgacgcccggguguacgcggaccccauggcccugaaggacuucaaggaguucgccuccggccgcaagagcaucacccuggacauccucacggagaucgccucccugccgaccuaccugagcucccgcgccaagcucgcgcuggacaacaucgucaugcugcacaccaccgagcggggcgggcgcgccuaccagcacgcccucaacgagcugcccgagagccuggagacgcucaugcugguggcccugcucggcgcgaugaccgccgggaucuuccuguucuucaugcagggcaaggggaucggcaagcugagcaugggccucaucaccaucgccguggccuccgggcugcugugggucgccgagauccagccccaguggaucgcggccagcaucauccucgaguucuuccugauggugcugcucaucccggagcccgagaagcagcggaccccccaggacaaccagcugaucuacgugauccugacgauccucaccaucaucggccugaucgccgccaacgagauggggcugaucgagaagaccaagaccgacuucggcuucuaccaggucaagacggagaccaccauccucgacguggaccugcgccccgccuccgcguggacccuguacgccguggccacgaccauccucaccccgaugcugcggcacaccaucgagaacacgagcgccaaccugucccucgccgcgaucgccaaccaggccgccguccugauggggcugggcaagggcuggccccuccaccgcauggaccugggggugccccugcucgccaugggcugcuacagccaggugaaccccaccacccugaccgcgucccuggucaugcuccuggugcacuacgccaucaucgggccgggccugcaggccaaggccacgcgggaggcgcagaagcgcaccgccgccggcaucaugaagaaccccaccguggacgggaucaccgucaucgaccucgagcccaucagcuacgaccccaaguucgagaagcagcugggccaggugaugcugcucgugcugugcgccgggcagcugcuccugaugcggacgaccugggccuucugcgagguccugacccucgcgaccggcccgauccugacgcugugggaggggaaccccggccgcuucuggaacaccaccaucgccguguccaccgccaacaucuuccggggcagcuaccucgccggggccggccuggcguucucccugaucaagaacgcccagacgccccgccgggggaccggcaccgccggggagacccucggcgagaaguggaagcgccagcugaacagccuggaccggaaggaguucgaggaguacaagcgcuccggcauccucgagguggaccggaccgaggccaagagcgcccugaaggacggguccaagaucaagcacgcggucagccgcggcuccagcaagauccgguggaucguggagcgcgggauggugaagcccaagggcaaggucguggaccuggggugcggccgcggcgggugguccuacuacauggccacgcucaagaacgugaccgaggucaagggcuacaccaaggggggcccggggcacgaggagcccauccccauggccaccuacggcuggaaccuggugaagcugcacagcggcguggacgucuucuacaagcccacggagcagguggacacccuccugugcgacaucggggagagcuccagcaacccgaccaucgaggagggccggacccugcgcgugcucaagauggucgagcccuggcuguccagcaagcccgaguucugcaucaaggugcugaaccccuacaugccgacggugaucgaggagcuggagaagcuccagcggaagcacgggggcaaccugguccgcugcccccugucccggaacagcacccacgagauguacuggguguccggcgccagcgggaacaucgucuccagcgugaacaccaccuccaagaugcuccugaaccgcuucacgacccggcaccgcaagcccaccuacgagaaggacguggaccugggcgcggggacccggagcgucuccacggagaccgagaagcccgacaugaccaucaucggccgccggcuccagcgccugcaggaggagcacaaggagaccuggcacuacgaccaggagaacccguaccggacgugggccuaccacgggagcuacgaggcccccuccaccggcagcgccuccagcauggugaacggcguggucaagcugcucaccaagcccugggacgugaucccgauggugacccagcuggccaugacggacaccacccccuucgggcagcagcgcgucuucaaggagaagguggacacccggacgccccagcccaagccgggcacccgcauggugaugaccaccacggcgaacuggcugugggcccuccuggggaagaagaagaacccccggcugugcacccgcgaggaguucaucuccaagguccggagcaacgccgccaucggcgccguguuccaggaggagcagggguggaccagcgcguccgaggccgugaacgacagccgcuucugggagcucgucgacaaggagcgggcccugcaccaggagggcaagugcgaguccugcguguacaacaugaugggcaagcgcgagaagaagcugggggaguucggccgcgccaaggggagccgggccaucugguacauguggcucggcgcgcgcuuccuggaguucgaggcccugggguuccucaacgaggaccacugguucggccgggagaacuccuggagcggcguggagggggagggccugcaccgccugggguacauccucgaggagaucgacaagaaggacggcgaccugauguacgccgacgacaccgccggcugggacacgcggaucaccgaggacgaccugcagaacgaggagcucaucaccgagcagauggcgccccaccacaagauccuggccaaggccaucuucaagcugaccuaccagaacaaggucgugaaggugcuccgccccaccccgcggggggccgucauggacaucaucucccgcaaggaccagcggggcagcgggcaggugggcacguacgggcugaacaccuucaccaacauggaggugcagcugauccgccagauggaggccgagggcgucaucacccaggacgacaugcagaaccccaagggccucaaggagcggguggagaaguggcugcgcgagugcgggguggaccggcugaagcgcauggcgaucuccggcgacgacugcgucgugaagccccucgacgagcgguucgggacgagccugcuguuccucaacgacaugggcaaggugcgcaaggacaucccccagugggagccguccaagggguggaagaacuggcaggagguccccuucugcagccaccacuuccacaagaucuucaugaaggacggccggucccugguggugcccugccgcaaccaggacgagcugaucggccgggcccgcaucagccagggggccggcuggucccuccgcgagaccgccugccuggggaaggccuacgcgcagauguggagccugauguacuuccaccggcgcgaccuccggcuggccuccauggccaucugcagcgccguccccaccgagugguucccgaccagccgcacgaccugguccauccacgcccaccaccaguggaugaccaccgaggacaugcugaagguguggaaccggguguggaucgaggacaaccccaacaugaucgacaagacgcccguccacagcugggaggacauccccuaccucggcaagcgcgaggaccuguggugcgggucccugaucggccucagcucccgggcgaccugggccaagaacauccacaccgccaucacccaggugcgcaaccugaucggcaaggaggaguacguggacuacaugccggucaugaagcgguacagcgcccccuccgagagcgagggggugcuguga

SEQ ID NO: 10511 - RNA, 9867 nt, Artificial Sequence
  derived and/or modified CDS sequence (opt1) from DENV-4__KJ596661__SS-prME
agcaccaucacccugcucugccugauccccacggugauggccuuccaccuguccacccgcgacggcgagccgcucaugaucgucgccaagcacgagcgggggcgcccccugcuguucaagaccaccgagggcaucaacaagugcacgcucaucgcgauggaccugggggagaugugcgaggacaccgugaccuacaagugcccccugcucgugaacaccgagcccgaggacaucgacugcuggugcaaccugacgagcaccugggucauguacggcaccugcacccaguccggggagcggcgccgggagaagcgcagcguggcccugacgccgcacuccggcaugggccucgagacccgggccgagaccuggaugagcuccgagggggccuggaagcacgcccagcgcguggagagcuggauccugcggaaccccggcuucgcgcugcucgccggguucauggccuacaugaucggccagaccgggauccagcgcacggucuucuucgugcugaugaugcugguggcccccuccuacggcaugcggugcgucggcguggggaaccgcgacuucguggagggcgucagcgggggcgcguggguggaccucgugcuggagcacggcgggugcgucaccaccauggcccagggcaagcccacccuggacuucgagcucacgaagaccaccgccaaggagguggcccugcugcggaccuacugcaucgaggcccucaucuccaacaucacgaccgcgacccgcugcccgacccagggggagcccuaccugaaggaggagcaggaccagcaguacaucugccggcgcgacguggucgaccggggcugggggaacggcugcggccuguucgggaagggcgggguggugacgugcgccaaguucagcugcuccggcaagaucaccgggaaccucguccagaucgagaaccuggaguacaccgugguggucaccgugcacaacggcgacacgcacgccgucggcaacgacaccagcaaccacggggugaccgccaccaucacgccccgcucccccagcguggaggucaagcugccggacuacggcgagcucacccuggacugcgagccccgguccgggaucgacuucaacgagaugauccugaugaagaugaagaagaagaccuggcucgugcacaagcagugguuccuggaccugccccuccccuggaccaccggcgccgacacgagcgaggugcacuggaacuacaaggagcgcauggucaccuucaaggugccgcacgcgaagcggcaggacgugaccguccuggggucccaggagggcgccaugcacagcgcccuggccggcgccaccgagguggacagcggggacggcaaccacauguucgcggggcaccucaagugcaaggugcgcauggagaagcugcgcaucaagggcauguccuacacgaugugcagcggcaaguucuccaucgacaaggagauggccgagacccagcacgggaccaccgucgugaaggugaaguacgagggcgccggggcccccugcaagguccccaucgagauccgggacgugaacaaggagaagguggucggccgcgugaucagcgccacgccccuggcggagaacaccaacuccgugaccaacaucgagcucgagccgcccuucggggacagcuacaucgucaucggcgugggcaacuccgcccugacccugcacugguuccggaaggggagcuccaucggcaagauguucgagagcacguaccgcggggccaagcggauggccauccucggcgagaccgcgugggacuucggguccgugggcggccuguucaccagccuggggaaggccguccaccagguguucggcuccguguacaccacgauguucgggggcgucagcuggaugauccgcauccucaucggguuccuggugcuguggaucggcaccaacucccggaacaccagcauggccaugaccugcaucgccgugggcgggaucacgcuguuccucggcuucaccguccaggccgacauggggugcgugguguccuggagcggccgcgagcugaagugcggguccggcaucuucgucguggacaacgugcacaccuggaccgagcaguacaaguuccagcccgagagccccgcgcggcuggccagcgccauccucaacgcccacaaggacggcgucugcgggauccgcuccacgacccggcuggagaacgugauguggaagcagaucaccaacgagcugaacuacgugcucugggagggcgggcacgaccugaccgucguggccggcgacgugaagggcguccugacgaaggggaagcgcgcgcucaccccgcccgccagcgaccugaaguacuccuggaagaccuggggcaaggccaagaucuucacccccgaggcccggaacagcacguuccugaucgacgggcccgacaccuccgagugcccgaacgagcgccgggccuggaacagcuucgagguggaggacuacggcuucgggauguucaccaccaacaucuggaugaaguuccgcgagggcuccagcgaggugugcgaccaccggcucauguccgcggccaucaaggaccagaaggccguccacgccgacaugggcuacuggaucgagagcuccaagaaccagacguggcagaucgagcgcgcgagccugaucgaggugaagaccugccuguggcccaagacccacacccucugguccaacggggugcuggagagccagaugcugauccccaaguccuacgccggcccguucagccagcacaacuaccggcagggguacgccacccagacggucggccccuggcaccucgggaagcuggagaucgacuucggcgagugccccggcaccaccgugaccauccaggagaacugcgaccaccgcgggcccucccugcgcacgaccaccgccagcggcaagcucgugacccaguggugcugccggagcugcacgaugccgccccugcgcuuccugggggaggacggcugcugguacgggauggagauccggccccucuccgagaaggaggagaacauggucaagagccaggugaccgccggccagggcaccuccgagaccuucagcauggggcugcugugccucacgcuguucgucgaggagugccugcgccggcgcgugacccggaagcacaugauccucgcgguggucaucacccugugcgccaucauccugggcgggcucaccuggauggaccugcugcgcgcccucaucaugcugggcgacacgauguccggccggaucgggggccagacccaccuggccaucauggccguguucaagaugagccccggguacgugcucggcgucuuccugcgcaagcugaccucccgggagaccgcgcucauggugaucgggauggccaugacgaccacccugagcaucccgcacgaccugauggagcucaucgacggcaucucccugggccugauccuccugaagaucgugacccaguucgacaacacgcaggucgggacccuggcccucagccugaccuucauccgcuccaccaugagccuggugauggccuggcggacgaucauggccgugcucuucgucgugacccugaucccccugugccgcaccuccugccuccagaagcagagccacuggguggagaucaccgcgcugauccugggcgcccaggcccuccccgucuaccugaugacgcugaugaagggggccucccggcgcagcuggccccucaacgagggcaucauggcgguggggcuggugucccugcucggcagcgcccugcugaagaacgacgucccgcucgccggccccaugguggccgggggccugcugcucgccgcguacgugauguccgggagcagcgccgaccugucccuggagaaggccgccaacguccagugggacgagauggccgacaucaccggcagcucccccaucaucgaggugaagcaggacgaggacgggagcuucuccauccgggacguggaggagaccaacaugaucacccuccuggucaagcuggcgcucaucacggugagcggccuguacccccuggccaucccgaucaccaugacccucugguacauguggcaggugaagacccagcgcuccggcgcccugugggacguccccagccccgccgccacccagaaggcggcccuguccgaggggguguaccggaucaugcagcgcggccucuucgggaagacgcaggugggcgucgggauccacaucgagggcguguuccacaccauguggcacgugacccggggcagcgucaucugccacgagaccgggcgccuggagcccuccugggccgacgugcgcaacgacaugaucagcuacggcgggggcuggcggcugggcgacaagugggacaaggaggaggacgugcagguccucgccaucgagccggggaagaaccccaagcacgugcagacgaagcccggccuguucaagacccugaccggggagaucggcgccgugacccucgacuucaagcccgggacguccggcagcccgaucaucaaccgcaagggcaaggucaucgggcuguacggcaacgggguggugaccaaguccggcgacuacgucagcgcgaucacccaggccgagcggaucggggagcccgacuacgagguggacgaggacaucuuccgcaagaagcggcugaccaucauggaccuccaccccggcgccggcaagacgaagcgcauccugccguccaucgugcgggaggcccugaagcgccggcugcgcacccucauccuggcgcccacccgggucguggccgccgagauggaggaggcccugcgcgggcuccccauccgguaccagacccccgccgugaagagcgagcacacgggccgcgagaucgucgaccugaugugccacgcgaccuucaccacccggcugcucuccagcacgcgcgugccgaacuacaaccugaucgugauggacgaggcccacuucaccgaccccagcuccgucgccgcccggggguacaucagcacccgcguggagaugggcgaggccgcggccaucuucaugaccgccacgccccccggggccaccgacccguucccccaguccaacagccccaucgaggacaucgagcgggagauccccgagcgcuccuggaacaccggcuucgacuggaucaccgacuaccagggcaagacggucugguucgugccgagcaucaaggccgggaacgacaucgcgaacugccugcgcaaguccggcaagaaggugauccagcucagccggaagaccuucgacaccgaguaccccaagaccaagcugacggacugggacuucgucgugaccaccgacaucuccgagaugggggccaacuuccgcgccggccgggugaucgacccccgccggugccugaagcccgucauccucaccgacgggccggagcgcgugauccuggccggccccauccccgugacgcccgcgagcgccgcccagcggcgcggccggaucgggcgcaacccggcccaggaggacgaccaguacgucuucuccggcgacccccugaagaacgacgaggaccacgcccacuggaccgaggcgaagaugcuccuggacaacaucuacacccccgaggggaucauccccacccuguucggcccggagcgggagaagacgcaggccaucgacggcgaguuccgccuccggggggagcagcgcaagaccuucguggagcugaugcggcgcggcgaccugcccguguggcucagcuacaaggucgccuccgccgggaucagcuacaaggaccgggaguggugcuucaccggcgagcgcaacaaccagauccuggaggagaacauggagguggagaucuggacccgggagggggagaagaagaagcugcgccccaaguggcucgacgcccggguguacgcggaccccauggcccugaaggacuucaaggaguucgccuccggccgcaagagcaucacccuggacauccucacggagaucgccucccugccgaccuaccugagcucccgcgccaagcucgcgcuggacaacaucgucaugcugcacaccaccgagcggggcgggcgcgccuaccagcacgcccucaacgagcugcccgagagccuggagacgcucaugcugguggcccugcucggcgcgaugaccgccgggaucuuccuguucuucaugcagggcaaggggaucggcaagcugagcaugggccucaucaccaucgccguggccuccgggcugcugugggucgccgagauccagccccaguggaucgcggccagcaucauccucgaguucuuccugauggugcugcucaucccggagcccgagaagcagcggaccccccaggacaaccagcugaucuacgugauccugacgauccucaccaucaucggccugaucgccgccaacgagauggggcugaucgagaagaccaagaccgacuucggcuucuaccaggucaagacggagaccaccauccucgacguggaccugcgccccgccuccgcguggacccuguacgccguggccacgaccauccucaccccgaugcugcggcacaccaucgagaacacgagcgccaaccugucccucgccgcgaucgccaaccaggccgccguccugauggggcugggcaagggcuggccccuccaccgcauggaccugggggugccccugcucgccaugggcugcuacagccaggugaaccccaccacccugaccgcgucccuggucaugcuccuggugcacuacgccaucaucgggccgggccugcaggccaaggccacgcgggaggcgcagaagcgcaccgccgccggcaucaugaagaaccccaccguggacgggaucaccgucaucgaccucgagcccaucagcuacgaccccaaguucgagaagcagcugggccaggugaugcugcucgugcugugcgccgggcagcugcuccugaugcggacgaccugggccuucugcgagguccugacccucgcgaccggcccgacgcugacccugugggaggggaaccccggccgcuucuggaacaccaccaucgccguguccacggccaacaucuuccggggcagcuaccucgccggggccggccuggcguucucccugaucaagaacgcccagaccccccgccgggggaccggcaccgccggggagacccucggcgagaaguggaagcgccagcugaacagccuggaccggaaggaguucgaggaguacaagcgcuccggcauccucgagguggaccggacggaggccaagagcgcccugaaggacggguccaagaucaagcacgcggucagccgcggcuccagcaagauccgguggaucguggagcgcgggauggugaagcccaagggcaaggucguggaccuggggugcggccgcggcgggugguccuacuacauggccacccucaagaacgugaccgaggucaagggcuacaccaaggggggcccggggcacgaggagcccauccccauggccacguacggcuggaaccuggugaagcugcacagcggcguggacgucuucuacaagcccaccgagcagguggacacccuccugugcgacaucggggagagcuccagcaacccgaccaucgaggagggccggacgcugcgcgugcucaagauggucgagcccuggcuguccagcaagcccgaguucugcaucaaggugcugaaccccuacaugccgaccgugaucgaggagcuggagaagcuccagcggaagcacgggggcaaccugguccgcugcccccugucccggaacagcacccacgagauguacuggguguccggcgccagcgggaacaucgucuccagcgugaacaccacguccaagaugcuccugaaccgcuucaccacccggcaccgcaagcccaccuacgagaaggacguggaccugggcgcggggacgcggagcgucuccaccgagaccgagaagcccgacaugaccaucaucggccgccggcuccagcgccugcaggaggagcacaaggagacguggcacuacgaccaggagaacccguaccggaccugggccuaccacgggagcuacgaggcccccuccaccggcagcgccuccagcauggugaacggcguggucaagcugcucaccaagcccugggacgugaucccgauggugacgcagcuggccaugaccgacaccacccccuucgggcagcagcgcgucuucaaggagaagguggacacgcggaccccccagcccaagccgggcacccgcauggugaugaccacgaccgcgaacuggcugugggcccuccuggggaagaagaagaacccccggcugugcacccgcgaggaguucaucuccaagguccggagcaacgccgccaucggcgccguguuccaggaggagcagggguggaccagcgcguccgaggccgugaacgacagccgcuucugggagcucgucgacaaggagcgggcccugcaccaggagggcaagugcgaguccugcguguacaacaugaugggcaagcgcgagaagaagcugggggaguucggccgcgccaaggggagccgggccaucugguacauguggcucggcgcgcgcuuccuggaguucgaggcccugggguuccucaacgaggaccacugguucggccgggagaacuccuggagcggcguggagggggagggccugcaccgccugggguacauccucgaggagaucgacaagaaggacggcgaccugauguacgccgacgacacggccggcugggacacccggaucaccgaggacgaccugcagaacgaggagcucaucaccgagcagauggcgccccaccacaagauccuggccaaggccaucuucaagcugaccuaccagaacaaggucgugaaggugcuccgccccacgccgcggggggccgucauggacaucaucucccgcaaggaccagcggggcagcgggcaggugggcaccuacgggcugaacaccuucaccaacauggaggugcagcugauccgccagauggaggccgagggcgucaucacgcaggacgacaugcagaaccccaagggccucaaggagcggguggagaaguggcugcgcgagugcgggguggaccggcugaagcgcauggcgaucuccggcgacgacugcgucgugaagccccucgacgagcgguucgggaccagccugcuguuccucaacgacaugggcaaggcccgcaaggacaucccccagugggagccguccaagggguggaagaacuggcaggaggugcccuucugcagccaccacuuccacaagaucuucaugaaggacggccggucccuggucgugcccugccgcaaccaggacgagcugaucggccgggcccgcaucagccagggggccggcuggucccuccgcgagaccgccugccuggggaaggcguacgcccagauguggagccugauguacuuccaccggcgcgaccuccggcuggccuccauggccaucugcagcgccgugcccaccgagugguucccgacgagccgcaccaccugguccauccacgcgcaccaccaguggaugaccacggaggacaugcugaaggucuggaaccggguguggaucgaggacaaccccaacaugaucgacaagacccccgugcacagcugggaggacauccccuaccucggcaagcgcgaggaccuguggugcgggucccugaucggccucagcucccgggccaccugggccaagaacauccacaccgccaucacgcagguccgcaaccugaucggcaaggaggaguacguggacuacaugccggugaugaagcgguacagcgcccccuccgagagcgaggggguccuguga

SEQ ID NO: 10512 - RNA, 9867 nt, Artificial Sequence
  derived and/or modified CDS sequence (opt1) from DENV-4__KJ596663__SS-prME
agcaccaucacccugcucugccugauccccacggugauggccuuccaccuguccacccgcgacggcgagccgcucaugaucgucgccaagcacgagcgggggcgcccccugcuguucaagaccaccgagggcaucaacaagugcacgcucaucgcgauggaccugggggagaugugcgaggacaccgugaccuacaagugcccccugcucgugaacaccgagcccgaggacaucgacugcuggugcaaccugacgagcaccugggucauguacggcaccugcacccaguccggggagcggcgccgggagaagcgcagcguggcccugacgccgcacuccggcaugggccucgagacccgggccgagaccuggaugagcuccgagggggccuggaagcacgcccagcgcguggagagcuggauccugcggaaccccggcuucgcgcugcucgccggguucauggccuacaugaucggccagaccgggauccagcgcacggucuucuucgugcugaugaugcugguggcccccuccuacggcaugcggugcgucggcguggggaaccgcgacuucguggagggcgucagcgggggcgcguggguggaccucgugcuggagcacggcgggugcgucaccaccauggcccagggcaagcccacccuggacuucgagcucacgaagaccaccgccaaggagguggcccugcugcggaccuacugcaucgaggcccucaucuccaacaucacgaccgcgacccgcugcccgacccagggggagcccuaccugaaggaggagcaggaccagcaguacaucugccggcgcgacguggucgaccggggcugggggaacggcugcggccuguucgggaagggcgggguggugacgugcgccaaguucagcugcuccggcaagaucaccgggaaccucguccagaucgagaaccuggaguacaccgugguggucaccgugcacaacggcgacacgcacgccgucggcaacgacaccagcaaccacggggugaccgccaccaucacgccccgcucccccagcguggaggucaagcugccggacuacggcgagcucacccuggacugcgagccccgguccgggaucgacuucaacgagaugauccugaugaagaugaagaagaagaccuggcucgugcacaagcagugguuccuggaccugccccuccccuggaccaccggcgccgacacgagcgaggugcacuggaacuacaaggagcgcauggucaccuucaaggugccgcacgcgaagcggcaggacgugaccguccuggggucccaggagggcgccaugcacagcgcccuggccggcgccaccgagguggacagcggggacggcaaccacauguucgcggggcaccucaagugcaaggugcgcauggagaagcugcgcaucaagggcauguccuacacgaugugcagcggcaaguucuccaucgacaaggagauggccgagacccagcacgggaccaccgucgugaaggugaaguacgagggcgccggggcccccugcaagguccccaucgagauccgggacgugaacaaggagaagguggucggccgcgugaucagcgccacgccccuggcggagaacaccaacuccgugaccaacaucgagcucgagccgcccuucggggacagcuacaucgucaucggcgugggcaacuccgcccugacccugcacugguuccggaaggggagcuccaucggcaagauguucgagagcacguaccgcggggccaagcggauggccauccucggcgagaccgcgugggacuucggguccgugggcggccuguucaccagccuggggaaggccguccaccagguguucggcuccguguacaccacgauguucgggggcgucagcuggaugauccgcauccucaucggguuccuggugcuguggaucggcaccaacucccggaacaccagcauggccaugaccugcaucgccgugggcgggaucacgcuguuccucggcuucaccguccaggccgacauggggugcgugguguccuggagcggccgcgagcugaagugcggguccggcaucuucgucguggacaacgugcacaccuggaccgagcaguacaaguuccagcccgagagccccgcgcggcuggccagcgccauccucaacgcccacaaggacggcgucugcgggauccgcuccacgacccggcuggagaacgugauguggaagcagaucaccaacgagcugaacuacgugcucugggagggcgggcacgaccugaccgucguggccggcgacgugaagggcguccugacgaaggggaagcgcgcgcucaccccgcccgccagcgaccugaaguacuccuggaagaccuggggcaaggccaagaucuucacccccgaggcccggaacagcacguuccugaucgacgggcccgacaccuccgagugcccgaacgagcgccgggccuggaacagcuucgagguggaggacuacggcuucgggauguucaccaccaacaucuggaugaaguuccgcgagggcuccagcgaggugugcgaccaccggcucauguccgcggccaucaaggaccagaaggccguccacgccgacaugggcuacuggaucgagagcuccaagaaccagacguggcagaucgagcgcgcgagccugaucgaggugaagaccugccuguggcccaagacccacacccucugguccaacggggugcuggagagccagaugcugauccccaaguccuacgccggcccguucagccagcacaacuaccggcagggguacgccacccagacggucggccccuggcaccucgggaagcuggagaucgacuucggcgagugccccggcaccaccgugaccauccaggagaacugcgaccaccgcgggcccucccugcgcacgaccaccgccagcggcaagcucgugacccaguggugcugccggagcugcacgaugccgccccugcgcuuccugggggaggacggcugcugguacgggauggagauccggccccucuccgagaaggaggagaacauggucaagagccaggugaccgccggccagggcaccuccgagaccuucagcauggggcugcugugccucacgcuguucgucgaggagugccugcgccggcgcgugacccggaagcacaugauccucgcgguggucaucacccugugcgccaucauccugggcgggcucaccuggauggaccugcugcgcgcccucaucauccugggcgacacgauguccggccggaucgggggccagacccaccuggccaucauggccguguucaagaugagccccggguacgugcucggcgucuuccugcgcaagcugaccucccgggagaccgcgcucauggugaucgggauggccaugacgaccacccugagcaucccgcacgaccugauggagcucaucgacggcaucucccugggccugauccuccugaagaucgugacccaguucgacaacacgcaggucgggacccuggcccucagccugaccuucauccgcuccaccaugagccuggugauggccuggcggacgaucauggccgugcucuucgucgugacccugaucccccugugccgcaccuccugccuccagaagcagagccacuggguggagaucaccgcgcugauccugggcgcccaggcccuccccgucuaccugaugacgcugaugaagggggccucccggcgcagcuggccccucaacgagggcaucauggcgguggggcuggugucccugcucggcagcgcccugcugaagaacgacgucccgcucgccggccccaugguggccgggggccugcugcucgccgcguacgugauguccgggagcagcgccgaccugucccuggagaaggccgccaacguccagugggacgagauggccgacaucaccggcagcucccccaucaucgaggugaagcaggacgaggacgggagcuucuccauccgggacguggaggagaccaacaugaucacccuccuggucaagcuggcgcucaucacggugagcggccuguacccccuggccaucccgaucaccaugacccucugguacauguggcaggugaagacccagcgcuccggcgcccugugggacguccccagccccgccgccacccagaaggcggcccuguccgaggggguguaccggaucaugcagcgcggccucuucgggaagacgcaggugggcgucgggauccacauggagggcguguuccacaccauguggcacgugacccggggcagcgucaucugccacgagaccgggcgccuggagcccuccugggccgacgugcgcaacgacaugaucagcuacggcgggggcuggcggcugggcgacaagugggacaaggaggaggacgugcagguccucgccaucgagccggggaagaaccccaagcacgugcagacgaagcccggccuguucaagacccugaccggggagaucggcgccgugacccucgacuucaagcccgggacguccggcagcccgaucaucaaccgcaagggcaaggucaucgggcuguacggcaacgggguggugaccaaguccggcgacuacgucagcgcgaucacccaggccgagcggaucggggagcccgacuacgagguggacgaggacaucuuccgcaagaagcggcugaccaucauggaccuccaccccggcgccggcaagacgaagcgcauccugccguccaucgugcgggaggcccugaagcgccggcugcgcacccucauccuggcgcccacccgggucguggccgccgagauggaggaggcccugcgcgggcuccccauccgguaccagacccccgccgugaagagcgagcacacgggccgcgagaucgucgaccugaugugccacgcgaccuucaccacccggcugcucuccagcacgcgcgugccgaacuacaaccugaucgugauggacgaggcccacuucaccgaccccagcuccgucgccgcccggggguacaucagcacccgcguggagaugggcgaggccgcggccaucuucaugaccgccacgccccccggggccaccgacccguucccccaguccaacagccccaucgaggacaucgagcgggagauccccgagcgcuccuggaacaccggcuucgacuggaucaccgacuaccagggcaagacggucugguucgugccgagcaucaaggccgggaacgacaucgcgaacugccugcgcaaguccggcaagaaggugauccagcucagccggaagaccuucgacaccgaguaccccaagaccaagcugacggacugggacuucgucgugaccaccgacaucuccgagaugggggccaacuuccgcgccggccgggugaucgacccccgccggugccugaagcccgucauccucaccgacgggccggagcgcgugauccuggccggccccauccccgugacgcccgcgagcgccgcccagcggcgcggccggaucgggcgcaacccggcccaggaggacgaccaguacgucuucuccggcgacccccugaagaacgacgaggaccacgcccacuggaccgaggcgaagaugcuccuggacaacaucuacacccccgaggggaucauccccacccuguucggcccggagcgggagaagacgcaggccaucgacggcgaguuccgccuccggggggagcagcgcaagaccuucguggagcugaugcggcgcggcgaccugcccguguggcucagcuacaaggucgccuccgccgggaucagcuacaaggaccgggaguggugcuucaccggcgagcgcaacaaccagauccuggaggagaacauggagguggagaucuggacccgggagggggagaagaagaagcugcgccccaaguggcucgacgcccggguguacgcggaccccauggcccugaaggacuucaaggaguucgccuccggccgcaagagcaucacccuggacauccucacggagaucgccucccugccgaccuaccugagcucccgcgccaagcucgcgcuggacaacaucgucaugcugcacaccaccgagcggggcgggcgcgccuaccagcacgcccucaacgagcugcccgagagccuggagacgcucaugcugguggcccugcucggcgcgaugaccgccgggaucuuccuguucuucaugcagggcaaggggaucggcaagcugagcaugggccucaucaccaucgccguggccuccgggcugcugugggucgccgagauccagccccaguggaucgcggccagcaucauccucgaguucuuccugauggugcugcucaucccggagcccgagaagcagcggaccccccaggacaaccagcugaucuacgugauccugacgauccucaccaucaucggccugaucgccgccaacgagauggggcugaucgagaagaccaagaccgacuucggcuucuaccaggucaagacggagaccaccauccucgacguggaccugcgccccgccuccgcguggacccuguacgccguggccacgaccauccucaccccgaugcugcggcacaccaucgagaacacgagcgccaaccugucccucgccgcgaucgccaaccaggccgccguccugauggggcugggcaagggcuggccccuccaccgcauggaccugggggugccccugcucgccaugggcugcuacagccaggugaaccccaccacccugaccgcgucccuggucaugcuccuggugcacuacgccaucaucgggccgggccugcaggccaaggccacgcgggaggcgcagaagcgcaccgccgccggcaucaugaagaaccccaccguggacgggaucaccgucaucgaccucgagcccaucagcuacgaccccaaguucgagaagcagcugggccaggugaugcugcucgugcugugcgccgggcagcugcuccugaugcggacgaccugggccuucugcgagguccugacccucgcgaccggcccgauccugacgcugugggaggggaaccccggccgcuucuggaacaccaccaucgccguguccaccgccaacaucuuccggggcagcuaccucgccggggccggccuggcguucucccugaucaagaacgcccagacgccccgccgggggaccggcaccgccggggagacccucggcgagaaguggaagcgccagcugaacagccuggaccggaaggaguucgaggaguacaagcgcuccggcauccucgagguggaccggaccgaggccaagagcgcccugaaggacggguccaagaucaagcacgcggucagccgcggcuccagcaagauccgguggaucguggagcgcgggauggugaagcccaagggcaaggucguggaccuggggugcggccgcggcgggugguccuacuacauggccacgcucaagaacgugaccgaggucaagggcuacaccaaggggggcccggggcacgaggagcccauccccauggccaccuacggcuggaaccuggugaagcugcacagcggcguggacgucuucuacaagcccacggagcagguggacacccuccugugcgacaucggggagagcuccagcaacccgaccaucgaggagggccggacccugcgcgugcucaagauggucgagcccuggcuguccagcaagcccgaguucugcaucaaggugcugaaccccuacaugccgacggugaucgaggagcuggagaagcuccagcggaagcacgggggcaaccugguccgcugcccccugucccggaacagcacccacgagauguacuggguguccggcgccagcgggaacaucgucuccagcgugaacaccaccuccaagaugcuccugaaccgcuucacgacccggcaccgcaagcccaccuacgagaaggacguggaccugggcgcggggacccggagcgucuccacggagaccgagaagcccgacaugaccaucaucggccgccggcuccagcgccugcaggaggagcacaaggagaccuggcacuacgaccaggagaacccguaccggacgugggccuaccacgggagcuacgaggcccccuccaccggcagcgccuccagcauggugaacggcguggucaagcugcucaccaagcccugggacgugaucccgauggugacccagcuggccaugacggacaccacccccuucgggcagcagcgcgucuucaaggagaagguggacacccggacgccccagcccaagccgggcacccgcauggugaugaccaccacggcgaacuggcugugggcccuccuggggaagaagaagaacccccggcugugcacccgcgaggaguucaucuccaagguccggagcaacgccgccaucggcgccguguuccaggaggagcagggguggaccagcgcguccgaggccgugaacgacagccgcuucugggagcucgucgacaaggagcgggcccugcaccaggagggcaagugcgaguccugcguguacaacaugaugggcaagcgcgagaagaagcugggggaguucggccgcgccaaggggagccgggccaucugguacauguggcucggcgcgcgcuuccuggaguucgaggcccugggguuccucaacgaggaccacugguucggccgggagaacuccuggagcggcguggagggggagggccugcaccgccugggguacauccucgaggagaucgacaagaaggacggcgaccugauguacgccgacgacaccgccggcugggacacgcggaucaccgaggacgaccugcagaacgaggagcucaucaccgagcagauggcgccccaccacaagacccuggccaaggccaucuucaagcugaccuaccagaacaaggucgugaaggugcuccgccccacgccgcggggggccgucauggacaucaucucccgcaaggaccagcggggcagcgggcaggugggcaccuacgggcugaacaccuucaccaacauggaggugcagcugauccgccagauggaggccgagggcgucaucacgcaggacgacaugcagaaccccaagggccucaaggagcggguggagaaguggcugcgcgagugcgggguggaccggcugaagcgcauggcgaucuccggcgacgacugcgucgugaagccccucgacgagcgguucgggaccagccugcuguuccucaacgacaugggcaaggugcgcaaggacaucccccagugggagccguccaagggguggaagaacuggcaggagguccccuucugcagccaccacuuccacaagaucuucaugaaggacggccggucccugguggugcccugccgcaaccaggacgagcugaucggccgggcccgcaucagccagggggccggcuggucccuccgcgagaccgccugccuggggaaggccuacgcgcagauguggagccugauguacuuccaccggcgcgaccuccggcuggccuccauggccaucugcagcgccguccccaccgagugguucccgacgagccgcaccaccugguccauccacgcccaccaccaguggaugaccacggaggacaugcugaagguguggaaccggguguggaucgaggacaaccccaacaugaucgacaagacccccguccacagcugggaggacauccccuaccucggcaagcgcgaggaccuguggugcgggucccugaucggccucagcucccgggcgaccugggccaagaacauccacaccgccaucacgcaggugcgcaaccugaucggcaaggaggaguacguggacuacaugccggucaugaagcgguacagcgcccccuccgagagcgagggggugcuguga

SEQ ID NO: 10513 - RNA, 9867 nt, Artificial Sequence
  derived and/or modified CDS sequence (opt1) from DENV-4__KJ596664__SS-prME
agcaccaucacccugcucugccugauccccacggugauggccuuccaccuguccacccgcgacggcgagccgcucaugaucgucgccaagcacgagcgggggcgcccccugcuguucaagaccaccgagggcaucaacaagugcacgcucaucgcgauggaccugggggagaugugcgaggacaccgugaccuacaagugcccccugcucgugaacaccgagcccgaggacaucgacugcuggugcaaccugacgagcaccugggucauguacggcaccugcacccaguccggggagcggcgccgggagaagcgcagcguggcccugacgccgcacuccggcaugggccucgagacccgggccgagaccuggaugagcuccgagggggccuggaagcacgcccagcgcguggagagcuggauccugcggaaccccggcuucgcgcugcucgccggguucauggccuacaugaucggccagaccgggauccagcgcacggucuucuucgugcugaugaugcugguggcccccuccuacggcaugcggugcgucggcguggggaaccgcgacuucguggagggcgucagcgggggcgcguggguggaccucgugcuggagcacggcgggugcgucaccaccauggcccagggcaagcccacccuggacuucgagcucacgaagaccaccgccaaggagguggcccugcugcggaccuacugcaucgaggcccucaucuccaacaucacgaccgcgacccgcugcccgacccagggggagcccuaccugaaggaggagcaggaccagcaguacaucugccggcgcgacguggucgaccggggcugggggaacggcugcggccuguucgggaagggcgggguggugacgugcgccaaguucagcugcuccggcaagaucaccgggaaccucguccagaucgagaaccuggaguacaccgugguggucaccgugcacaacggcgacacgcacgccgucggcaacgacaccagcaaccacggggugaccgccaccaucacgccccgcucccccagcguggaggucaagcugccggacuacggcgagcucacccuggacugcgagccccgguccgggaucgacuucaacgagaugauccugaugaagaugaagaagaagaccuggcucgugcacaagcagugguuccuggaccugccccuccccuggaccaccggcgccgacacgagcgaggugcacuggaacuacaaggagcgcauggucaccuucaaggugccgcacgcgaagcggcaggacgugaccguccuggggucccaggagggcgccaugcacagcgcccuggccggcgccaccgagguggacagcggggacggcaaccacauguucgcggggcaccucaagugcaaggugcgcauggagaagcugcgcaucaagggcauguccuacacgaugugcagcggcaaguucuccaucgacaaggagauggccgagacccagcacgggaccaccgucgugaaggugaaguacgagggcgccggggcccccugcaagguccccaucgagauccgggacgugaacaaggagaagguggucggccgcgugaucagcgccacgccccuggcggagaacaccaacuccgugaccaacaucgagcucgagccgcccuucggggacagcuacaucgucaucggcgugggcaacuccgcccugacccugcacugguuccggaaggggagcuccaucggcaagauguucgagagcacguaccgcggggccaagcggauggccauccucggcgagaccgcgugggacuucggguccgugggcggccuguucaccagccuggggaaggccguccaccagguguucggcuccguguacaccacgauguucgggggcgucagcuggaugauccgcauccucaucggguuccuggugcuguggaucggcaccaacucccggaacaccagcauggccaugaccugcaucgccgugggcgggaucacgcuguuccucggcuucaccguccaggccgacauggggugcgugguguccuggagcggccgcgagcugaagugcggguccggcaucuucgucguggacaacgugcacaccuggaccgagcaguacaaguuccagcccgagagccccgcgcggcuggccagcgccauccucaacgcccacaaggacggcgucugcgggauccgcuccacgacccggcuggagaacgugauguggaagcagaucaccaacgagcugaacuacgugcucugggagggcgggcacgaccugaccgucguggccggcgacgugaagggcguccugacgaaggggaagcgcgcgcucaccccgcccgccagcgaccugaaguacuccuggaagaccuggggcaaggccaagaucuucacccccgaggcccggaacagcacguuccugaucgacgggcccgacaccuccgagugcccgaacgagcgccgggccuggaacagcuucgagguggaggacuacggcuucgggauguucaccaccaacaucuggaugaaguuccgcgagggcuccagcgaggugugcgaccaccggcucauguccgcggccaucaaggaccagaaggccguccacgccgacaugggcuacuggaucgagagcuccaagaaccagacguggcagaucgagcgcgcgagccugaucgaggugaagaccugccuguggcccaagacccacacccucugguccaacggggugcuggagagccagaugcugauccccaaguccuacgccggcccguucagccagcacaacuaccggcagggguacgccacccagacggucggccccuggcaccucgggaagcuggagaucgacuucggcgagugccccggcaccaccgugaccauccaggagaacugcgaccaccgcgggcccucccugcgcacgaccaccgccagcggcaagcucgugacccaguggugcugccggagcugcacgaugccgccccugcgcuuccugggggaggacggcugcugguacgggauggagauccggccccucuccgagaaggaggagaacauggucaagagccaggugaccgccggccagggcaccuccgagaccuucagcauggggcugcugugccucacgcuguucgucgaggagugccugcgccggcgcgugacccggaagcacaugauccucgcgguggucaucacccugugcgccaucauccugggcgggcucaccuggauggaccugcugcgcgcccucaucaugcugggcgacacgauguccggccggaucgggggccagacccaccuggccaucaucgccguguucaagaugagccccggguacgugcucggcgucuuccugcgcaagcugaccucccgggagaccgcgcucauggugaucgggauggccaugacgaccacccugagcaucccgcacgaccugauggagcucaucgacggcaucucccugggccugauccuccugaagaucgugacccaguucgacaacacgcaggucgggacccuggcccucagccugaccuucauccgcuccaccaugagccuggugauggccuggcggacgaucauggccgugcucuucgucgugacccugaucccccugugccgcaccuccugccuccagaagcagagccacuggguggagaucaccgcgcugauccugggcgcccaggcccuccccgucuaccugaugacgcugaugaagggggccucccggcgcagcuggccccucaacgagggcaucauggcgguggggcuggugucccugcucggcagcgcccugcugaagaacgacgucccgcucgccggccccaugguggccgggggccugcugcucgccgcguacgugauguccgggagcagcgccgaccugucccuggagaaggccgccaacguccagugggacgagauggccgacaucaccggcagcucccccaucaucgaggugaagcaggacgaggacgggagcuucuccauccgggacguggaggagaccaacaugaucacccuccuggucaagcuggcgcucaucacggugagcggccuguacccccuggccaucccgaucaccaugacccucugguacauguggcaggugaagacccagcgcuccggcgcccugugggacguccccagccccgccgccacccagaaggcggcccuguccgaggggguguaccggaucaugcagcgcggccucuucgggaagacgcaggugggcgucgggauccacauggagggcguguuccacaccauguggcacgugacccggggcagcgucaucugccacgagaccgggcgccuggagcccuccugggccgacgugcgcaacgacaugaucagcuacggcgggggcuggcggcugggcgacaagugggacaaggaggaggacgugcagguccucgccaucgagccggggaagaaccccaagcacgugcagacgaagcccggccuguucaagacccugaccggggagaucggcgccgugacccucgacuucaagcccgggacguccggcagcccgaucaucaaccgcaagggcaaggucaucgggcuguacggcaacgggguggugaccaaguccggcgacuacgucagcgcgaucacccaggccgagcggaucggggagcccgacuacgagguggacgaggacaucuuccgcaagaagcggcugaccaucauggaccuccaccccggcgccggcaagacgaagcgcauccugccguccaucgugcgggaggcccugaagcgccggcugcgcacccucauccuggcgcccacccgggucguggccgccgagauggaggaggcccugcgcgggcuccccauccgguaccagacccccgccgugaagagcgagcacacgggccgcgagaucgucgaccugaugugccacgcgaccuucaccacccggcugcucuccagcacgcgcgugccgaacuacaaccugaucgugauggacgaggcccacuucaccgaccccagcuccgucgccgcccggggguacaucagcacccgcguggagaugggcgaggccgcggccaucuucaugaccgccacgccccccggggccaccgacccguucccccaguccaacagccccaucgaggacaucgagcgggagauccccgagcgcuccuggaacaccggcuucgacuggaucaccgacuaccagggcaagacggucugguucgugccgagcaucaaggccgggaacgacaucgcgaacugccugcgcaaguccggcaagaaggugauccagcucagccggaagaccuucgacaccgaguaccccaagaccaagcugacggacugggacuucgucgugaccaccgacaucuccgagaugggggccaacuuccgcgccggccgggugaucgacccccgccggugccugaagcccgucauccucaccgacgggccggagcgcgugauccuggccggccccauccccgugacgcccgcgagcgccgcccagcggcgcggccggaucgggcgcaacccggcccaggaggacgaccaguacgucuucuccggcgacccccugaagaacgacgaggaccacgcccacuggaccgaggcgaagaugcuccuggacaacaucuacacccccgaggggaucauccccacccuguucggcccggagcgggagaagacgcaggccaucgacggcgaguuccgccuccggggggagcagcgcaagaccuucguggagcugaugcggcgcggcgaccugcccguguggcucagcuacaaggucgccuccgccgggaucagcuacaaggaccgggaguggugcuucaccggcgagcgcaacaaccagauccuggaggagaacauggagguggagaucuggacccgggagggggagaagaagaagcugcgccccaaguggcucgacgcccggguguacgcggaccccauggcccugaaggacuucaaggaguucgccuccggccgcaagagcaucacccuggacauccucacggagaucgccucccugccgaccuaccugagcucccgcgccaagcucgcgcuggacaacaucgucaugcugcacaccaccgagcggggcgggcgcgccuaccagcacgcccucaacgagcugcccgagagccuggagacgcucaugcugguggcccugcucggcgcgaugaccgccgggaucuuccuguucuucaugcagggcaaggggaucggcaagcugagcaugggccucaucaccaucgccguggccuccgggcugcugugggucgccgagauccagccccaguggaucgcggccagcaucauccucgaguucuuccugauggugcugcucaucccggagcccgagaagcagcggaccccccaggacaaccagcugaucuacgugauccugacgauccucaccaucaucggccugaucgccgccaacgagauggggcugaucgagaagaccaagaccgacuucggcuucuaccaggucaagacggagaccaccauccucgacguggaccugcgccccgccuccgcguggacccuguacgccguggccacgaccauccucaccccgaugcugcggcacaccaucgagaacacgagcgccaaccugucccucgccgcgaucgccaaccaggccgccguccugauggggcugggcaagggcuggccccuccaccgcauggaccugggggugccccugcucgccaugggcugcuacagccaggugaaccccaccacccugaccgcgucccuggucaugcuccuggugcacuacgccaucaucgggccgggccugcaggccaaggccacgcgggaggcgcagaagcgcaccgccgccggcaucaugaagaaccccaccguggacgggaucaccgucaucgaccucgagcccaucagcuacgaccccaaguucgagaagcagcugggccaggugaugcugcucgugcugugcgccgggcagcugcuccugaugcggacgaccugggccuucugcgagguccugacccucgcgaccggcccgauccugacgcugugggaggggaaccccggccgcuucuggaacaccaccaucgccguguccaccgccaacaucuuccggggcagcuaccucgccggggccggccuggcguucucccugaucaagaacgcccagacgccccgccgggggaccggcaccgccggggagacccucggcgagaaguggaagcgccagcugaacagccuggaccggaaggaguucgaggaguacaagcgcuccggcauccucgagguggaccggaccgaggccaagagcgcccugaaggacggguccaagaucaagcacgcggucagccgcggcuccagcaagauccgguggaucguggagcgcgggauggugaagcccaagggcaaggucguggaccuggggugcggccgcggcgggugguccuacuacauggccacgcucaagaacgugaccgaggucaagggcuacaccaaggggggcccggggcacgaggagcccauccccauggccaccuacggcuggaaccuggugaagcugcacagcggcguggacgucuucuacaagcccacggagcagguggacacccuccugugcgacaucggggagagcuccagcaacccgaccaucgaggagggccggacccugcgcgugcucaagauggucgagcccuggcuguccagcaagcccgaguucugcaucaaggugcugaaccccuacaugccgacggugaucgaggagcuggagaagcuccagcggaagcacgggggcaaccugguccgcugcccccugucccggaacagcacccacgagauguacuggguguccggcgccagcgggaacaucgucuccagcgugaacaccaccuccaagaugcuccugaaccgcuucacgacccggcaccgcaagcccaccuacgagaaggacguggaccugggcgcggggacccggagcgucuccacggagaucgagaagcccgacaugaccaucaucggccgccggcuccagcgccugcaggaggagcacaaggagaccuggcacuacgaccaggagaacccguaccggaccugggccuaccacgggagcuacgaggcccccuccacgggcagcgccuccagcauggugaacggcguggucaagcugcucaccaagcccugggacgugaucccgauggugacccagcuggccaugaccgacacgacccccuucgggcagcagcgcgucuucaaggagaagguggacacccggaccccccagcccaagccgggcacgcgcauggugaugaccaccaccgcgaacuggcugugggcccuccuggggaagaagaagaacccccggcugugcacgcgcgaggaguucaucuccaagguccggagcaacgccgccaucggcgccguguuccaggaggagcagggguggaccagcgcguccgaggccgugaacgacagccgcuucugggagcucgucgacaaggagcgggcccugcaccaggagggcaagugcgaguccugcguguacaacaugaugggcaagcgcgagaagaagcugggggaguucggccgcgccaaggggagccgggccaucugguacauguggcucggcgcgcgcuuccuggaguucgaggcccugggguuccucaacgaggaccacugguucggccgggagaacuccuggagcggcguggagggggagggccugcaccgccugggguacauccucgaggagaucgacaagaaggacggcgaccugauguacgccgacgacaccgccggcugggacacccggaucacggaggacgaccugcagaacgaggagcucaucaccgagcagauggcgccccaccacaagauccuggccaaggccaucuucaagcugaccuaccagaacaaggucgugaaggugcuccgccccaccccgcggggggccgucauggacaucaucucccgcaaggaccagcggggcagcgggcaggugggcaccuacgggcugaacacguucaccaacauggaggugcagcugauccgccagauggaggccgagggcgucaucacccaggacgacaugcagaaccccaagggccucaaggagcggguggagaaguggcugcgcgagugcgggguggaccggcugaagcgcauggcgaucuccggcgacgacugcgucgugaagccccucgacgagcgguucgggaccagccugcuguuccucaacgacaugggcaaggugcgcaaggacaucccccagugggagccguccaagggguggaagaacuggcaggagguccccuucugcagccaccacuuccacaagaucuucaugaaggacggccggucccugguggugcccugccgcaaccaggacgagcugaucggccgggcccgcaucagccagggggccggcuggaaccuccgcgagacggccugccuggggaaggccuacgcgcagauguggucccugauguacuuccaccggcgcgaccuccggcuggccagcauggccaucugcuccgccguccccaccgagugguucccgaccagccgcaccacguggagcauccacgcccaccaccaguggaugaccaccgaggacaugcugaagguguggaaccggguguggaucgaggacaaccccaacaugaucgacaagacccccguccacuccugggaggacauccccuaccucggcaagcgcgaggaccuguggugcgggagccugaucggccucuccagccgggcgacgugggccaagaacauccacaccgccaucacccaggugcgcaaccugaucggcaaggaggaguacguggacuacauguccgucaugaagcgguacagcgccccguccgagagcgagggggugcuguga

SEQ ID NO: 10514 - RNA, 9867 nt, Artificial Sequence
  derived and/or modified CDS sequence (opt1) from DENV-4__KJ596665__SS-prME
agcaccaucacccugcucugccugauccccacggugauggccuuccaccuguccacccgcgacggcgagccccucaugaucguggccaagcacgagcgggggcggccccugcuguucaagaccaccgagggcaucaacaagugcacgcucaucgcgauggaccugggggagaugugcgaggacaccgugaccuacaagugcccccugcucgugaacaccgagcccgaggacaucgacugcuggugcaaccugacgagcaccugggugauguacgggaccugcacccaguccggggagcggcgccgggagaagcgcagcguggcccugacgccgcacuccggcaugggccucgagacccgggccgagaccuggaugagcuccgagggggccuggaagcacgcccagcgcguggagagcuggauccugcggaaccccggcuucgcgcugcucgccggguucauggccuacaugaucggccagaccgggauccagcgcacgguguucuucgugcugaugaugcugguggcccccuccuacggcaugcggugcgucggcguggggaaccgcgacuucguggagggcgucagcgggggcgcguggguggaccucgugcuggagcacggcgggugcgucaccaccauggcccagggcaagcccacccuggacuucgagcucacgaagaccaccgccaaggagguggcccugcugcggaccuacugcaucgaggcccucaucuccaacaucacgaccgcgacccgcugcccgacccagggggagcccuaccugaaggaggagcaggaccagcaguacaucugccggcgcgacguggucgaccggggcugggggaacggcugcggccuguucgggaagggcgggguggugacgugcgccaaguucagcugcuccggcaagaucaccgggaaccucguccagaucgagaaccuggaguacaccgugguggucaccgugcacaacggcgacacgcacgccgucggcaacgacaccagcaaccacggggugaccgccaccaucacgccccgcucccccagcguggaggucaagcugccggacuacggcgagcucacccuggacugcgagccccgguccgggaucgacuucaacgagaugauccugaugaagaugaagaagaagaccuggcucgugcacaagcagugguuccuggaccugccccuccccuggaccaccggcgccgacacgagcgaggugcacuggaacuacaaggagcgcauggucaccuucaaggugccgcacgcgaagcggcaggacgugaccguccuggggucccaggagggcgccaugcacagcgcccuggccggcgccaccgagguggacagcggggacggcaaccacauguucgcggggcaccucaagugcaaggugcgcauggagaagcugcgcaucaagggcauguccuacacgaugugcagcggcaaguucuccaucgacaaggagauggccgagacccagcacgggaccaccgucgugaaggugaaguacgagggcgccggggcccccugcaagguccccaucgagauccgggacgugaacaaggagaagguggucggccgcgugaucagcgccacgccccuggcggagaacaccaacuccgugaccaacaucgagcucgagccgcccuucggggacagcuacaucgucaucggcgugggcaacuccgcccugacccugcacugguuccggaaggggagcuccaucggcaagauguucgagagcacguaccgcggggccaagcggauggccauccucggcgagaccgcgugggacuucggguccgugggcggccuguucaccagccuggggaaggccguccaccagguguucggcuccguguacaccacgauguucgggggcgucagcuggaugauccgcauccucaucggguuccuggugcuguggaucggcaccaacucccggaacaccagcauggccaugaccugcaucgccgugggcgggaucacgcuguuccucggcuucaccguccaggccgacauggggugcgugguguccuggagcggccgcgagcugaagugcggguccggcaucuucgucguggacaacgugcacaccuggaccgagcaguacaaguuccagcccgagagccccgcgcggcuggccagcgccauccucaacgcccacaaggacggcgucugcgggauccgcuccacgacccggcuggagaacgugauguggaagcagaucaccaacgagcugaacuacgugcucugggagggcgggcacgaccugaccgucguggccggcgacgugaagggcguccugacgaaggggaagcgcgcgcucaccccgcccgccagcggccugaaguacuccuggaagaccugggggaaggccaagaucuucacccccgaggcccggaacagcacguuccugaucgacggccccgacaccuccgagugcccgaacgagcgccgggccuggaacagcuucgagguggaggacuacggguucggcauguucaccaccaacaucuggaugaaguuccgcgagggcuccagcgaggugugcgaccaccggcucauguccgcggccaucaaggaccagaaggccguccacgccgacaugggguacuggaucgagagcuccaagaaccagacguggcagaucgagcgcgcgagccugaucgaggugaagaccugccuguggcccaagacccacacccucugguccaacggcgugcuggagagccagaugcugauccccaaguccuacgccgggccguucagccagcacaacuaccggcagggcuacgccacccagacggucgggcccuggcaccucggcaagcuggagaucgacuucggcgagugccccgggaccaccgugaccauccaggagaacugcgaccaccgcggccccucccugcgcacgaccaccgccagcgggaagcucgugacccaguggugcugccggagcugcacgaugccgccccugcgcuuccugggcgaggacgggugcugguacggcauggagauccggccccucuccgagaaggaggagaacauggucaagagccaggugaccgccggccaggggaccuccgagaccuucagcaugggccugcugugccucacgcuguucgucgaggagugccugcgccggcgcgugacccggaagcacaugauccucgcgguggucaucacccugugcgccaucauccucggcgggcucaccuggauggaccugcugcgcgcccucaucauccugggggacacgauguccgggcggaucggcgggcagacccaccuggccaucauggccguguucaagaugagccccggcuacgugcucggggucuuccugcgcaagcugaccucccgggagaccgcgcucauggugaucggcauggccaugacgaccacccugagcaucccgcacgaccugauggagcucaucgacggcaucucccuggggcugauccuccugaagaucgugacccaguucgacaacacgcaggucggcacccuggcccucagccugaccuucauccgcuccaccaugagccuggugauggccuggcggacgaucauggccgugcuguucgucgugacccugaucccccugugccgcaccuccugccuccagaagcagagccacuggguggagaucaccgcgcugauccugggggcccaggcccuccccgucuaccugaugacgcugaugaagggcgccucccggcgcagcuggccccucaacgaggggaucauggcggugggccuggugucccugcucggcagcgcccugcugaagaacgacgucccgcucgccgggcccaugguggccggcgggcugcugcucgccgcguacgugauguccggcagcagcgccgaccugucccuggagaaggccgccaacguccagugggacgagauggccgacaucaccgggagcucccccaucaucgaggugaagcaggacgaggacggcagcuucuccauccgggacguggaggagaccaacaugaucacccuccuggucaagcuggcgcucaucacggugagcggccuguacccccuggccaucccgaucaccaugacccucugguacauguggcaggucaagacccagcgcuccggggcccugugggacguccccagccccgccgccacccagaaggcggcccuguccgagggcguguaccggaucaugcagcgcggccucuucggcaagacccaggugggggucggcauccacauggagggcguguuccacaccauguggcacgugacccgggggagcgucaucugccacgagaccggccgccuggagcccuccugggccgacgugcgcaacgacaugaucagcuacgggggcggcuggcggcugggggacaagugggacaaggaggaggacgugcagguccucgccaucgagccgggcaagaaccccaagcacgugcagacgaagcccgggcuguucaagacccugaccggcgagaucggggccgugacccucgacuucaagcccggcacguccggcagcccgaucaucaaccgcaaggggaaggucaucggccuguacgggaacggcguggugaccaaguccggggacuacgucagcgcgaucacccaggccgagcggaucggcgagcccgacuacgagguggacgaggacaucuuccgcaagaagcggcugaccaucauggaccuccaccccggcgccgggaagacgaagcgcauccugccguccaucgugcgggaggcccugaagcgccggcugcgcacccucauccuggcgcccacccgggucguggccgccgagauggaggaggcccugcgcggccuccccauccgguaccagacccccgccgucaagagcgagcacacggggcgcgagaucgucgaccugaugugccacgcgaccuucaccacccggcugcucuccagcacgcgcgugccgaacuacaaccugaucgugauggacgaggcccacuucaccgaccccagcuccgucgccgcccggggcuacaucagcacccgcguggagaugggggaggccgcggccaucuucaugaccgccacgccgcccggcgccaccgacccguucccccaguccaacagccccaucgaggacaucgagcgggagauccccgagcgcuccuggaacaccggcuucgacuggaucaccgacuaccaggggaagacggucugguucgugccgagcaucaaggccggcaacgacaucgcgaacugccugcgcaaguccgggaagaaggugauccagcucagccggaagaccuucgacaccgaguaccccaagaccaagcugacggacugggacuucgucgugaccaccgacaucuccgagaugggcgccaacuuccgcgccgggcgggugaucgacccccgccggugccugaagcccgucauccucaccgacggcccggagcgcgugauccuggccggccccauccccgugacgcccgcgagcgccgcccagcggcgcgggcggaucggccgcaacccggcccaggaggacgaccaguacgucuucuccggggacccccugaagaacgacgaggaccacgcccacuggaccgaggcgaagaugcuccuggacaacaucuacacccccgagggcaucauccccacccuguucggcccggagcgggagaagacgcaggccaucgacggggaguuccgccuccggggcgagcagcgcaagaccuucguggagcugaugcggcgcggggaccugcccguguggcucagcuacaaggucgccuccgccggcaucagcuacaaggaccgggaguggugcuucaccggggagcgcaacaaccagauccuggaggagaacauggagguggagaucuggacccgggagggcgagaagaagaagcugcgccccaaguggcucgacgcccggguguacgcggaccccauggcccugaaggacuucaaggaguucgccuccggccgcaagagcaucacccuggacauccucacggagaucgccucccugccgaccuaccugagcucccgcgccaagcucgcgcuggacaacaucgucaugcugcacaccaccgagcgcgggggccgcgccuaccagcacgcccucaacgagcugcccgagagccuggagacgcucaugcugguggcccugcucggggcgaugaccgccggcaucuuccuguucuucaugcaggggaagggcaucggcaagcugagcauggggcucaucaccaucgccguggccuccggccugcugugggucgccgagauccagccccaguggaucgcggccagcaucauccucgaguucuuccugauggugcugcucaucccggagcccgagaagcagcggacgccccaggacaaccagcugaucuacgugauccugacgauccucaccaucaucgggcugaucgccgccaacgagaugggccugaucgagaagaccaagaccgacuucggguucuaccaggucaagacggagaccaccauccucgacguggaccugcgccccgccuccgcguggacccuguacgccguggccacgaccauccucaccccgaugcugcggcacaccaucgagaacacgagcgccaaccugucccucgccgcgaucgccaaccaggccgccguccugaugggccugggcaagggguggccccuccaccgcauggaccugggcgugccccugcucgccauggggugcuacagccaggugaaccccaccacccugaccgcgucccuggucaugcuccuggugcacuacgccaucaucggcccgggccugcaggccaaggccacgcgggaggcgcagaagcgcaccgccgccgggaucaugaagaaccccaccguggacggcaucaccgucaucgaccucgagcccaucagcuacgaccccaaguucgagaagcagcugggccaggugaugcugcucgugcugugcgccggccagcugcuccugaugcggacgaccugggccuucugcgagguccugacccucgcgaccgggccgauccugacgcugugggagggcaaccccggccgcuucuggaacaccaccaucgccguguccaccgccaacaucuuccgggggagcuaccucgccggcgccgggcuggcguucucccugaucaagaacgcccagacgccccgccggggcaccgggaccgccggcgagacccucggcgagaaguggaagcgccagcugaacagccuggaccggaaggaguucgaggaguacaagcgcuccgggauccucgagguggaccggaccgaggccaagagcgcccugaaggacggcuccaagaucaagcacgcggucagccgcggguccagcaagauccgguggaucguggagcgcggcauggugaagcccaaggggaaggucguggaccugggcugcggccgcgggggcugguccuacuacauggccacgcucaagaacgugaccgaggucaagggguacaccaagggcgggccgggccacgaggagcccauccccauggccaccuacggcuggaaccuggugaagcugcacagcgggguggacgucuucuacaagcccacggagcaggucgacacccuccugugcgacaucggcgagagcuccagcaacccgaccaucgaggaggggcggacccugcgcgugcucaagauggucgagcccuggcuguccagcaagcccgaguucugcaucaaggugcugaaccccuacaugccgacggugaucgaggagcuggagaagcuccagcggaagcacggcggcaaccugguccgcugcccccugucccggaacagcacccacgagauguacuggguguccggggccagcggcaacaucgucuccagcgugaacaccaccuccaagaugcuccugaaccgcuucacgacccggcaccgcaagcccaccuacgagaaggacguggaccugggggcgggcacccggagcgucuccacggagaccgagaagcccgacaugaccaucaucgggcgccggcuccagcgccugcaggaggagcacaaggagaccuggcacuacgaccaggagaacccguaccggacgugggccuaccacggcagcuacgaggcccccuccaccggcagcgccuccagcauggugaacgggguggucaagcugcucaccaagcccugggacgugaucccgauggugacccagcuggccaugacggacaccacccccuucggccagcagcgcgucuucaaggagaagguggacacccggacgccccagcccaagccggggacccgcauggugaugaccaccacggcgaacuggcugugggcccuccugggcaagaagaagaacccccggcugugcacccgcgaggaguucaucuccaagguccggagcaacgccgccaucggggccguguuccaggaggagcagggcuggaccagcgcguccgaggccgugaacgacagccgcuucugggagcucgucgacaaggagcgggcccugcaccaggagggcaagugcgaguccugcguguacaacaugauggggaagcgcgagaagaagcugggcgaguucgggcgcgccaagggcagccgggccaucugguacauguggcucggggcgcgcuuccuggaguucgaggcccugggcuuccucaacgaggaccacugguucggccgggagaacuccuggagcgggguggagggcgaggggcugcaccgccugggcuacauccucgaggagaucgacaagaaggacggcgaccugauguacgccgacgacaccgccgggugggacacgcggaucaccgaggacgaccugcagaacgaggagcucaucaccgagcagauggcgccccaccacaagauccuggccaaggccaucuucaagcugaccuaccagaacaaggucgugaaggugcuccgccccaccccgcggggcgccgucauggacaucaucucccgcaaggaccagcgggggagcggccagguggggacguacggccugaacaccuucaccaacauggaggugcagcugauccgccagauggaggccgagggcgucaucacccaggacgacaugcagaaccccaaggggcucaaggagcggguggagaaguggcugcgcgagugcggcguggaccggcugaagcgcauggcgaucuccggggacgacugcgucgugaagccccucgacgagcgguucggcacgagccugcuguuccucaacgacauggggaaggugcgcaaggacaucccccagugggagccguccaagggcuggaagaacuggcaggagguccccuucugcagccaccacuuccacaagaucuucaugaaggacggccggucccugguggugcccugccgcaaccaggacgagcugaucgggcgggcccgcaucagccagggcgccggguggucccuccgcgagaccgccugccugggcaaggccuacgcgcagauguggagccugauguacuuccaccggcgcgaccuccggcuggccuccauggccaucugcagcgccguccccaccgagugguucccgaccagccgcacgaccugguccauccacgcccaccaccaguggaugaccaccgagaacaugcugaagguguggaaccggguguggaucgaggacaaccccaacaugaucgacaagacgcccguccacagcugggaggacauccccuaccucgggaagcgcgaggaccuguggugcggcucccugaucggccucagcucccgggcgaccugggccaagaacauccacaccgccaucacccaggugcgcaaccugaucgggaaggaggaguacguggacuacaugccggucaugaagcgguacagcgcccccuccgagagcgagggcgugcuguga

SEQ ID NO: 10515 - RNA, 9867 nt, Artificial Sequence
  derived and/or modified CDS sequence (opt1) from DENV-4__KJ596668__SS-prME
agcaccaucacccugcucugccugauccccacggugauggccuuccaccuguccacccgcgacggcgagccgcucaugaucgucgccaagcacgagcgggggcgcccccugcuguucaagaccaccgagggcaucaacaagugcacgcucaucgcgauggaccugggggagaugugcgaggacaccgugaccuacaagugcccccugcucgugaacaccgagcccgaggacaucgacugcuggugcaaccugacgagcaccugggucauguacggcaccugcacccaguccggggagcggcgccgggagaagcgcagcguggcccugacgccgcacuccggcaugggccucgagacccgggccgagaccuggaugagcuccgagggggccuggaagcacgcccagcgcguggagagcuggauccugcggaaccccggcuucgcgcugcucgccggguucauggccuacaugaucggccagaccgggauccagcgcacggucuucuucgugcugaugaugcugguggcccccuccuacggcaugcggugcgucggcguggggaaccgcgacuucguggagggcgucagcgggggcgcguggguggaccucgugcuggagcacggcgggugcgucaccaccauggcccagggcaagcccacccuggacuucgagcucacgaagaccaccgccaaggagguggcccugcugcggaccuacugcaucgaggcccucaucuccaacaucacgaccgcgacccgcugcccgacccagggggagcccuaccugaaggaggagcaggaccagcaguacaucugccggcgcgacguggucgaccggggcugggggaacggcugcggccuguucgggaagggcgggguggugacgugcgccaaguucagcugcuccggcaagaucaccgggaaccucguccagaucgagaaccuggaguacaccgugguggucaccgugcacaacggcgacacgcacgccgucggcaacgacaccagcaaccacggggugaccgccaccaucacgccccgcucccccagcguggaggucaagcugccggacuacggcgagcucacccuggacugcgagccccgguccgggaucgacuucaacgagaugauccugaugaagaugaagaagaagaccuggcucgugcacaagcagugguuccuggaccugccccuccccuggaccaccggcgccgacacgagcgaggugcacuggaacuacaaggagcgcauggucaccuucaaggugccgcacgcgaagcggcaggacgugaccguccuggggucccaggagggcgccaugcacagcgcccuggccggcgccaccgagguggacagcggggacggcaaccacauguucgcggggcaccucaagugcaaggugcgcauggagaagcugcgcaucaagggcauguccuacacgaugugcagcggcaaguucuccaucgacaaggagauggccgagacccagcacgggaccaccgucgugaaggugaaguacgagggcgccggggcccccugcaagguccccaucgagauccgggacgugaacaaggagaagguggucggccgcgugaucagcgccacgccccuggcggagaacaccaacuccgugaccaacaucgagcucgagccgcccuucggggacagcuacaucgucaucggcgugggcaacuccgcccugacccugcacugguuccggaaggggagcuccaucggcaagauguucgagagcacguaccgcggggccaagcggauggccauccucggcgagaccgcgugggacuucggguccgugggcggccuguucaccagccuggggaaggccguccaccagguguucggcuccguguacaccacgauguucgggggcgucagcuggaugauccgcauccucaucggguuccuggugcuguggaucggcaccaacucccggaacaccagcauggccaugaccugcaucgccgugggcgggaucacgcuguuccucggcuucaccguccaggccgacauggggugcgugguguccuggagcggccgcgagcugaagugcggguccggcaucuucgucguggacaacgugcacaccuggaccgagcaguacaaguuccagcccgagagccccgcgcggcuggccagcgccauccucaacgcccacaaggacggcgucugcgggauccgcuccacgacccggcuggagaacgugauguggaagcagaucaccaacgagcugaacuacgugcucugggagggcgggcacgaccugaccgucguggccggcgacgugaagggcguccugacgaaggggaagcgcgcgcucaccccgcccgccagcgaccugaaguacuccuggaagaccuggggcaaggccaagaucuucacccccgaggcccggaacagcacguuccugaucgacgggcccgacaccuccgagugcccgaacgagcgccgggccuggaacagcuucgagguggaggacuacggcuucgggauguucaccaccaacaucuggaugaaguuccgcgagggcuccagcgaggugugcgaccaccggcucauguccgcggccaucaaggaccagaaggccguccacgccgacaugggcuacuggaucgagagcuccaagaaccagacguggcagaucgagcgcgcgagccugaucgaggugaagaccugccuguggcccaagacccacacccucugguccaacggggugcuggagagccagaugcugauccccaaguccuacgccggcccguucagccagcacaacuaccggcagggguacgccacccagacggucggccccuggcaccucgggaagcuggagaucgacuucggcgagugccccggcaccaccgugaccauccaggagaacugcgaccaccgcgggcccucccugcgcacgaccaccgccagcggcaagcucgugacccaguggugcugccggagcugcacgaugccgccccugcgcuuccugggggaggacggcugcugguacgggauggagauccggccccucuccgagaaggaggagaacauggucaagagccaggugaccgccggccagggcaccuccgagaccuucagcauggggcugcugugccucacgcuguucgucgaggagugccugcgccggcgcgugacccggaagcacaugauccucgcgguggucaucacccugugcgccaucauccugggcgggcucaccuggauggaccugcugcgcgcccucaucauccugggcgacacgauguccggccggaucgggggccagacccaccuggccaucauggccguguucaagaugagccccggguacgugcucggcgucuuccugcgcaagcugaccucccgggagaccgcgcucauggugaucgggauggccaugacgaccacccugagcaucccgcacgaccugauggagcucaucgacggcaucucccugggccugauccuccugaagaucgugacccaguucgacaacacgcaggucgggacccuggcccucagccugaccuucauccgcuccaccaugagccuggugauggccuggcggacgaucauggccgugcucuucgucgugacccugaucccccugugccgcaccuccugccuccagaagcagagccacuggguggagaucaccgcgcugauccugggcgcccaggcccuccccgucuaccugaugacgcugaugaagggggccucccggcgcagcuggccccucaacgagggcaucauggcgguggggcuggugucccugcucggcagcgcccugcugaagaacgacgucccgcucgccggccccaugguggccgggggccugcugcucgccgcguacgugauguccgggagcagcgccgaccugucccuggagaaggccgccaacguccagugggacgagauggccgacaucaccggcagcucccccaucaucgaggugaagcaggacgaggacgggagcuucuccauccgggacguggaggagaccaacaugaucacccuccuggucaagcuggcgcucaucacggugagcggccuguacccccuggccaucccggugaccaugacccucugguacauguggcaggucaagacccagcgcuccggcgcccugugggacgugcccagccccgccgccacccagaaggcggcccuguccgaggggguguaccggaucaugcagcgcggccucuucgggaagacgcaggucggcguggggauccacauggagggcguguuccacaccauguggcacgucacccggggcagcgugaucugccacgagaccgggcgccuggagcccuccugggccgacgugcgcaacgacaugaucagcuacggcgggggcuggcggcugggcgacaagugggacaaggaggaggacguccaggugcucgccaucgagccggggaagaaccccaagcacgugcagacgaagcccggccuguucaagacccugaccggggagaucggcgccgucacccucgacuucaagcccgggacguccggcagcccgaucaucaaccgcaagggcaaggugaucgggcuguacggcaacgggguggucaccaaguccggcgacuacgugagcgcgaucacccaggccgagcggaucggggagcccgacuacgagguggacgaggacaucuuccgcaagaagcggcugaccaucauggaccuccaccccggcgccggcaagacgaagcgcauccugccguccaucguccgggaggcccugaagcgccggcugcgcacccucauccuggcgcccacccgggugguggccgccgagauggaggaggcccugcgcgggcuccccauccgguaccagacccccgccgucaagagcgagcacacgggccgcgagaucguggaccugaugugccacgcgaccuucaccacccggcugcucuccagcacgcgcgugccgaacuacaaccugaucgucauggacgaggcccacuucaccgaccccagcuccguggccgcccggggguacaucagcacccgcgucgagaugggcgaggccgcggccaucuucaugaccgccacgccccccggggccaccgacccguucccccaguccaacagccccaucgaggacaucgagcgggagauccccgagcgcuccuggaacaccggcuucgacuggaucaccgacuaccagggcaagacggugugguucgugccgagcaucaaggccgggaacgacaucgcgaacugccugcgcaaguccggcaagaaggucauccagcucagccggaagaccuucgacaccgaguaccccaagaccaagcugacggacugggacuucguggugaccaccgacaucuccgagaugggggccaacuuccgcgccggccgggucaucgacccccgccggugccugaagcccgugauccucaccgacgggccggagcgcgugauccuggccggccccauccccgucacgcccgcgagcgccgcccagcggcgcggccggaucgggcgcaacccggcccaggaggacgaccaguacguguucuccggcgacccccugaagaacgacgaggaccacgcccacuggaccgaggcgaagaugcuccuggacaacaucuacacccccgaggggaucauccccacccuguucggcccggagcgggagaagacgcaggccaucgacggcgaguuccgccuccggggggagcagcgcaagaccuucguggagcugaugcggcgcggcgaccugcccgucuggcucagcuacaagguggccuccgccgggaucagcuacaaggaccgggaguggugcuucaccggcgagcgcaacaaccagauccuggaggagaacauggagguggagaucuggacccgggagggggagaagaagaagcugcgccccaaguggcucgacgcccgggucuacgcggaccccauggcccugaaggacuucaaggaguucgccuccggccgcaagagcaucacccuggacauccucacggagaucgccucccugccgaccuaccugagcucccgcgccaagcucgcgcuggacaacaucgugaugcugcacaccaccgagcggggcgggcgcgccuaccagcacgcccucaacgagcugcccgagagccuggagacgcucaugcugguggcccugcucggcgcgaugaccgccgggaucuuccuguucuucaugcagggcaaggggaucggcaagcugagcaugggccucaucaccaucgccgucgccuccgggcugcuguggguggccgagauccagccccaguggaucgcggccagcaucauccucgaguucuuccugauggugcugcucaucccggagcccgagaagcagcggaccccccaggacaaccagcugaucuacgucauccugacgauccucaccaucaucggccugaucgccgccaacgagauggggcugaucgagaagaccaagaccgacuucggcuucuaccaggugaagacggagaccaccauccucgacguggaccugcgccccgccuccgcguggacccuguacgccgucgccacgaccauccucaccccgaugcugcggcacaccaucgagaacacgagcgccaaccugucccucgccgcgaucgccaaccaggccgccgugcugauggggcugggcaagggcuggccccuccaccgcauggaccugggggugccccugcucgccaugggcugcuacagccaggucaaccccaccacccugaccgcgucccuggugaugcuccuggugcacuacgccaucaucgggccgggccugcaggccaaggccacgcgggaggcgcagaagcgcaccgccgccggcaucaugaagaaccccaccgucgacgggaucaccgugaucgaccucgagcccaucagcuacgaccccaaguucgagaagcagcugggccaggugaugcugcucguccugugcgccgggcagcugcuccugaugcggacgaccugggccuucugcgaggugcugacccucgcgaccggcccgauccugacgcugugggaggggaaccccggccgcuucuggaacaccaccaucgccguguccaccgccaacaucuuccggggcagcuaccucgccggggccggccuggcguucucccugaucaagaacgcccagacgccccgccgggggaccggcaccgccggggagacccucggcgagaaguggaagcgccagcugaacagccuggaccggaaggaguucgaggaguacaagcgcuccggcauccucgaggucgaccggaccgaggccaagagcgcccugaaggacggguccaagaucaagcacgcggugagccgcggcuccagcaagauccgguggaucguggagcgcgggauggucaagcccaagggcaaggugguggaccuggggugcggccgcggcgggugguccuacuacauggccacgcucaagaacgucaccgaggugaagggcuacaccaaggggggcccggggcacgaggagcccauccccauggccaccuacggcuggaaccuggugaagcugcacagcggcgucgacguguucuacaagcccacggagcagguggacacccuccugugcgacaucggggagagcuccagcaacccgaccaucgaggagggccggacccugcgcguccucaagaugguggagcccuggcuguccagcaagcccgaguucugcaucaaggugcugaaccccuacaugccgacggucaucgaggagcuggagaagcuccagcggaagcacgggggcaaccuggugcgcugcccccugucccggaacagcacccacgagauguacugggucuccggcgccagcgggaacaucguguccagcgugaacaccaccuccaagaugcuccugaaccgcuucacgacccggcaccgcaagcccaccuacgagaaggacgucgaccugggcgcggggacccggagcguguccacggagaccgagaagcccgacaugaccaucaucggccgccggcuccagcgccugcaggaggagcacaaggagaccuggcacuacgaccaggagaacccguaccggacgugggccuaccacgggagcuacgaggcccccuccaccggcagcgccuccagcauggugaacggcgucgugaagcugcucaccaagcccugggacgugaucccgauggucacccagcuggccaugacggacaccacccccuucgggcagcagcgcguguucaaggagaagguggacacccggacgccccagcccaagccgggcacccgcauggucaugaccaccacggcgaacuggcugugggcccuccuggggaagaagaagaacccccggcugugcacccgcgaggaguucaucuccaaggugcggagcaacgccgccaucggcgccguguuccaggaggagcagggguggaccagcgcguccgaggccgucaacgacagccgcuucugggagcucguggacaaggagcgggcccugcaccaggagggcaagugcgaguccugcguguacaacaugaugggcaagcgcgagaagaagcugggggaguucggccgcgccaaggggagccgggccaucugguacauguggcucggcgcgcgcuuccuggaguucgaggcccugggguuccucaacgaggaccacugguucggccgggagaacuccuggagcggcgucgagggggagggccugcaccgccugggguacauccucgaggagaucgacaagaaggacggcgaccugauguacgccgacgacaccgccggcugggacacgcggaucaccgaggacgaccugcagaacgaggagcucaucaccgagcagauggcgccccaccacaagauccuggccaaggccaucuucaagcugaccuaccagaacaagguggugaagguccuccgccccaccccgcggggggccgugauggacaucaucucccgcaaggaccagcggggcagcgggcaggugggcacguacgggcugaacaccuucaccaacauggagguccagcugauccgccagauggaggccgagggcgugaucacccaggacgacaugcagaaccccaagggccucaaggagcggguggagaaguggcugcgcgaguacggggucgaccggcugaagcgcauggcgaucuccggcgacgacugcguggugaagccccucgacgagcgguucgggacgagccugcuguuccucaacgacaugggcaagguccgcaaggacaucccccagugggagccguccaagggguggaagaacuggcaggaggugcccuucugcagccaccacuuccacaagaucuucaugaaggacggccggucccuggugguccccugccgcaaccaggacgagcugaucggccgggcccgcaucagccagggggccggcuggucccuccgcgagaccgccugccuggggaaggccuacgcgcagauguggagccugauguacuuccaccggcgcgaccuccggcuggccuccauggccaucugcagcgccgugcccaccgagugguucccgaccagccgcacgaccugguccauccacgcccaccaccaguggaugaccaccgaggacaugcugaagguguggaaccgggucuggaucgaggacaaccccaacaugaucgacaagacgcccgugcacagcugggaggacauccccuaccucggcaagcgcgaggaccuguggugcgggucccugaucggccucagcucccgggcgaccugggccaagaacauccacaccgccaucacccaggugcgcaaccugaucggcaaggaggaguacgucgacuacaugccggugaugaagcgguacagcgcccccuccgagagcgagggggugcuguga

SEQ ID NO: 10516 - RNA, 9867 nt, Artificial Sequence
  derived and/or modified CDS sequence (opt1) from DENV-4__KJ596670__SS-prME
agcaccaucacccugcucugccugauccccacggugauggccuuccaccuguccacccgcgacggcgagccgcucaugaucgucgccaagcacgagcgggggcgcccccugcuguucaagaccaccgagggcaucaacaagugcacgcucaucgcgauggaccugggggagaugugcgaggacaccgugaccuacaagugcccccugcucgugaacaccgagcccgaggacaucgacugcuggugcaaccugacgagcaccugggucauguacggcaccugcacccaguccggggagcggcgccgggagaagcgcagcguggcccugacgccgcacuccggcaugggccucgagacccgggccgagaccuggaugagcuccgagggggccuggaagcacgcccagcgcguggagagcuggauccugcggaaccccggcuucgcgcugcucgccggguucauggccuacaugaucggccagaccgggauccagcgcacggucuucuucgugcugaugaugcugguggcccccuccuacggcaugcggugcgucggcguggggaaccgcgacuucguggagggcgucagcgggggcgcguggguggaccucgugcuggagcacggcgggugcgucaccaccauggcccagggcaagcccacccuggacuucgagcucacgaagaccaccgccaaggagguggcccugcugcggaccuacugcaucgaggcccucaucuccaacaucacgaccgcgacccgcugcccgacccagggggagcccuaccugaaggaggagcaggaccagcaguacaucugccggcgcgacguggucgaccggggcugggggaacggcugcggccuguucgggaagggcgggguggugacgugcgccaaguucagcugcuccggcaagaucaccgggaaccucguccagaucgagaaccuggaguacaccgugguggucaccgugcacaacggcgacacgcacgccgucggcaacgacaccagcaaccacggggugaccgccaccaucacgccccgcucccccagcguggaggucaagcugccggacuacggcgagcucacccuggacugcgagccccgguccgggaucgacuucaacgagaugauccugaugaagaugaagaagaagaccuggcucgugcacaagcagugguuccuggaccugccccuccccuggaccaccggcgccgacacgagcgaggugcacuggaacuacaaggagcgcauggucaccuucaaggugccgcacgcgaagcggcaggacgugaccguccuggggucccaggagggcgccaugcacagcgcccuggccggcgccaccgagguggacagcggggacggcaaccacauguucgcggggcaccucaagugcaaggugcgcauggagaagcugcgcaucaagggcauguccuacacgaugugcagcggcaaguucuccaucgacaaggagauggccgagacccagcacgggaccaccgucgugaaggugaaguacgagggcgccggggcccccugcaagguccccaucgagauccgggacgugaacaaggagaagguggucggccgcgugaucagcgccacgccccuggcggagaacaccaacuccgugaccaacaucgagcucgagccgcccuucggggacagcuacaucgucaucggcgugggcaacuccgcccugacccugcacugguuccggaaggggagcuccaucggcaagauguucgagagcacguaccgcggggccaagcggauggccauccucggcgagaccgcgugggacuucggguccgugggcggccuguucaccagccuggggaaggccguccaccagguguucggcuccguguacaccacgauguucgggggcgucagcuggaugauccgcauccucaucggguuccuggugcuguggaucggcaccaacucccggaacaccagcauggccaugaccugcaucgccgugggcgggaucacgcuguuccucggcuucaccguccaggccgacauggggugcgugguguccuggagcggccgcgagcugaagugcggguccggcaucuucgucguggacaacgugcacaccuggaccgagcaguacaaguuccagcccgagagccccgcgcggcuggccagcgccauccucaacgcccacaaggacggcgucugcgggauccgcuccacgacccggcuggagaacgugauguggaagcagaucaccaacgagcugaacuacgugcucugggagggcgggcacgaccugaccgucguggccggcgacgugaagggcguccugacgaaggggaagcgcgcgcucaccccgcccgccagcgaccugaaguacuccuggaagaccuggggcaaggccaagaucuucacccccgaggcccggaacagcacguuccugaucgacgggcccgacaccuccgagugcccgaacgagcgccgggccuggaacagcuucgagguggaggacuacggcuucgggauguucaccaccaacaucuggaugaaguuccgcgagggcuccagcgaggugugcgaccaccggcucauguccgcggccaucaaggaccagaaggccguccacgccgacaugggcuacuggaucgagagcuccaagaaccagacguggcagaucgagcgcgcgagccugaucgaggugaagaccugccuguggcccaagacccacacccucugguccaacggggugcuggagagccagaugcugauccccaaguccuacgccggcccguucagccagcacaacuaccggcagggguacgccacccagacggucggccccuggcaccucgggaagcuggagaucgacuucggcgagugccccggcaccaccgugaccauccaggagaacugcgaccaccgcgggcccucccugcgcacgaccaccgccagcggcaagcucgugacccaguggugcugccggagcugcacgaugccgccccugcgcuuccugggggaggacggcugcugguacgggauggagauccggccccucuccgagaaggaggagaacauggucaagagccaggugaccgccggccagggcaccuccgagaccuucagcauggggcugcugugccucacgcuguucgucgaggagugccugcgccggcgcgugacccggaagcacaugauccucgcgguggucaucacccugugcgccaucgugcugggcgggcucaccuggauggaccugcugcgcgcccucaucaugcugggcgacacgauguccggccggaucgggggccagacccaccuggccaucaucgccguguucaagaugagccccggguacguccucggcguguuccugcgcaagcugaccucccgggagaccgcgcucauggugaucgggauggccaugacgaccacccugagcaucccgcacgaccugauggagcucaucgacggcaucucccugggccugauccuccugaagaucgucacccaguucgacaacacgcagguggggacccuggcccucagccugaccuucauccgcuccaccaugagccuggugauggccuggcggacgaucauggccguccucuucguggugacccugaucccccugugccgcaccuccugccuccagaagcagagccacugggucgagaucaccgcgcugauccugggcgcccaggcccuccccguguaccugaugacgcugaugaagggggccucccggcgcagcuggccccucaacgagggcaucauggcgguggggcuggucucccugcucggcagcgcccugcugaagaacgacgugccgcucgccggccccaugguggccgggggccugcugcucgccgcguacgucauguccgggagcagcgccgaccugucccuggagaaggccgccaacgugcagugggacgagauggccgacaucaccggcagcucccccaucaucgaggugaagcaggacgaggacgggagcuucuccauccgggacgucgaggagaccaacaugaucacccuccuggugaagcuggcgcucaucacggugagcggccuguacccccuggccaucccgaucaccaugacccucugguacauguggcaggucaagacccagcgcuccggcgcccugugggacgugcccagccccgccgccacccagaaggcggcccuguccgaggggguguaccggaucaugcagcgcggccucuucgggaagacgcagaucggcgucgggauccacauggagggcguguuccacaccauguggcacgugacccggggcagcgucaucugccacgagaccgggcgccuggagcccuccugggccgacgugcgcaacgacaugaucagcuacggcgggggcuggcggcugggcgacaagugggacaaggaggaggacgugcagguccucgccaucgagccggggaagaaccccaagcacgugcagacgaagcccggccuguucaagacccugaccggggagaucggcgccgugacccucgacuucaagcccgggacguccggcagcccgaucaucaaccgcaagggcaaggucaucgggcuguacggcaacgggguggugaccaaguccggcgacuacgucagcgcgaucacccaggccgagcggaucggggagcccgacuacgagguggacgaggacaucuuccgcaagaagcggcugaccaucauggaccuccaccccggcgccggcaagacgaagcgcauccugccguccaucgugcgggaggcccugaagcgccggcugcgcacccucauccuggcgcccacccgggucguggccgccgagauggaggaggcccugcgcgggcuccccauccgguaccagacccccgccgugaagagcgagcacacgggccgcgagaucgucgaccugaugugccacgcgaccuucaccacccggcugcucuccagcacgcgcgugccgaacuacaaccugaucgugauggacgaggcccacuucaccgaccccagcuccgucgccgcccggggguacaucagcacccgcguggagaugggcgaggccgcggccaucuucaugaccgccacgccccccggggccaccgacccguucccccaguccaacagccccaucgaggacaucgagcgggagauccccgagcgcuccuggaacaccggcuucgacuggaucaccgacuaccagggcaagacggucugguucgugccgagcaucaaggccgggaacgacaucgcgaacugccugcgcaaguccggcaagaaggugauccagcucagccggaagaccuucgacaccgaguaccccaagaccaagcugacggacugggacuucgucgugaccaccgacaucuccgagaugggggccaacuuccgcgccggccgggugaucgacccccgccggugccugaagcccgucauccucaccgacgggccggagcgcgugauccuggccggccccauccccgugacgcccgcgagcgccgcccagcggcgcggccggaucgggcgcaacccggcccaggaggacgaccaguacgucuucuccggcgacccccugaagaacgacgaggaccacgcccacuggaccgaggcgaagaugcuccuggacaacaucuacacccccgaggggaucauccccacccuguucggcccggagcgggagaagacgcaggccaucgacggcgaguuccgccuccggggggagcagcgcaagaccuucguggagcugaugcggcgcggcgaccugcccguguggcucagcuacaaggucgccuccgccgggaucagcuacaaggaccgggaguggugcuucaccggcgagcgcaacaaccagauccuggaggagaacauggagguggagaucuggacccgggagggggagaagaagaagcugcgccccaaguggcucgacgcccggguguacgcggaccccauggcccugaaggacuucaaggaguucgccuccggccgcaagagcaucacccuggacauccucacggagaucgccucccugccgaccuaccugagcucccgcgccaagcucgcgcuggacaacaucgucaugcugcacaccaccgagcggggcgggcgcgccuaccagcacgcccucaacgagcugcccgagagccuggagacgcucaugcugguggcccugcucggcgcgaugaccgccgggaucuuccuguucuucaugcagggcaaggggaucggcaagcugagcaugggccucaucaccaucgccguggccuccgggcugcugugggucgccgagauccagccccaguggaucgcggccagcaucauccucgaguucuuccugauggugcugcucaucccggagcccgagaagcagcggaccccccaggacaaccagcugaucuacgugauccugacgauccucaccaucaucggccugaucgccgccaacgagauggggcugaucgagaagaccaagaccgacuucggcuucuaccaggucaagacggagaccaccauccucgacguggaccugcgccccgccuccgcguggacccuguacgccguggccacgaccauccucaccccgaugcugcggcacaccaucgagaacacgagcgccaaccugucccucgccgcgaucgccaaccaggccgccguccugauggggcugggcaagggcuggccccuccaccgcauggaccugggggugccccugcucgccaugggcugcuacagccaggugaaccccaccacccugaccgcgucccuggucaugcuccuggugcacuacgccaucaucgggccgggccugcaggccaaggccacgcgggaggcgcagaagcgcaccgccgccggcaucaugaagaaccccaccguggacgggaucaccgucaucgaccucgagcccaucagcuacgaccccaaguucgagaagcagcugggccaggugaugcugcucgugcugugcgccgggcagcugcuccugaugcggacgaccugggccuucugcgagguccugacccucgcgaccggcccgauccugacgcugugggaggggaaccccggccgcuucuggaacaccaccaucgccguguccaccgccaacaucuuccggggcagcuaccucgccggggccggccuggcguucucccugaucaagaacgcccagacgccccgccgggggaccggcaccgccggggagacccucggcgagaaguggaagcgccagcugaacagccuggaccggaaggaguucgaggaguacaagcgcuccggcauccucgagguggaccggaccgaggccaagagcgcccugaaggacggguccaagaucaagcacgcggucagccgcggcuccagcaagauccgguggaucguggagcgcgggauggugaagcccaagggcaaggucguggaccuggggugcggccgcggcgggugguccuacuacauggccacgcucaagaacgugaccgaggucaagggcuacaccaaggggggcccggggcacgaggagcccauccccauggccaccuacggcuggaaccuggugaagcugcacagcggcguggacgucuucuacaagcccacggagcagguggacacccuccugugcgacaucggggagagcuccagcaacccgaccaucgaggagggccggacccugcgcgugcucaagauggucgagcccuggcuguccagcaagcccgaguucugcaucaaggugcugaaccccuacaugccgacggugaucgaggagcuggagaagcuccagcggaagcacgggggcaaccugguccgcugcccccugucccggaacagcacccacgagauguacuggguguccggcgccagcgggaacaucgucuccagcgugaacaccaccuccaagaugcuccugaaccgcuucacgacccggcaccgcaagcccaccuacgagaaggacguggaccugggcgcggggacccggagcgucuccacggagaucgagaagcccgacaugaccaucaucggccgccggcuccagcgccugcaggaggagcacaaggagaccuggcacuacgaccaggagaacccguaccggaccugggccuaccacgggagcuacgaggcccccuccacgggcagcgccuccagcauggugaacggcguggucaagcugcucaccaagcccugggacgugaucccgauggugacccagcuggccaugaccgacacgacccccuucgggcagcagcgcgucuucaaggagaagguggacacccggaccccccagcccaagccgggcacgcgcauggugaugaccaccaccgcgaacuggcugugggcccuccuggggaagaagaagaacccccggcugugcacgcgcgaggaguucaucuccaagguccggagcaacgccgccaucggcgccguguuccaggaggagcagggguggaccagcgcguccgaggccgugaacgacagccgcuucugggagcucgucgacaaggagcgggcccugcaccaggagggcaagugcgaguccugcguguacaacaugaugggcaagcgcgagaagaagcugggggaguucggccgcgccaaggggagccgggccaucugguacauguggcucggcgcgcgcuuccuggaguucgaggcccugggguuccucaacgaggaccacugguucggccgggagaacuccuggagcggcguggagggggagggccugcaccgccugggguacauccucgaggagaucgacaagaaggacggcgaccugauguacgccgacgacaccgccggcugggacacccggaucacggaggacgaccugcagaacgaggagcucaucaccgagcagauggcgccccaccacaagauccuggccaaggccaucuucaagcugaccuaccagaacaaggucgugaaggugcuccgccccaccccgcggggggccgucauggacaucaucucccgcaaggaccagcggggcagcgggcaggugggcaccuacgggcugaacacguucaccaacauggaggugcagcugauccgccagauggaggccgagggcgucaucacccaggacgacaugcagaaccccaagggccucaaggagcggguggagaaguggcugcgcgagugcgggguggaccggcugaagcgcauggcgaucuccggcgacgacugcgucgugaagccccucgacgagcgguucgggaccagccugcuguuccucaacgacaugggcaaggugcgcaaggacaucccccagugggagccguccaagggguggaagaacuggcaggagguccccuucugcagccaccacuuccacaagaucuucaugaaggacggccggucccugguggugcccugccgcaaccaggacgagcugaucggccgggcccgcaucagccagggggccggcuggucccuccgcgagacggccugccuggggaaggccuacgcgcagauguggagccugauguacuuccaccggcgcgaccuccggcuggccuccauggccaucugcagcgccguccccaccgagugguucccgaccagccgcaccacgugguccauccacgcccaccaccaguggaugaccaccgaggacaugcugaagguguggaaccggguguggaucgaggacaaccccaacaugaucgacaagacccccguccacagcugggaggacauccccuaccucggcaagcgcgaggaccuguggugcgggucccugaucggccucagcucccgggcgacgugggccaagaacauccacaccgccaucacccaggugcgcaaccugaucggcaaggaggaguacguggacuacaugagcgucaugaagcgguacuccgccccgagcgaguccgagggggugcuguga

SEQ ID NO: 10517 - RNA, 9867 nt, Artificial Sequence
  derived and/or modified CDS sequence (opt1) from DENV-4__KJ596671__SS-prME
agcaccaucacccugcucugccugauccccacggugauggccuuccaccuguccacccgcgacggcgagccgcucaugaucgucgccaagcacgagcgggggcgcccccugcuguucaagaccaccgagggcaucaacaagugcacgcucaucgcgauggaccugggggagaugugcgaggacaccgugaccuacaagugcccccugcucgugaacaccgagcccgaggacaucgacugcuggugcaaccugacgagcaccugggucauguacggcaccugcacccaguccggggagcggcgccgggagaagcgcagcguggcccugacgccgcacuccggcaugggccucgagacccgggccgagaccuggaugagcuccgagggggccuggaagcacgcccagcgcguggagagcuggauccugcggaaccccggcuucgcgcugcucgccggguucauggccuacaugaucggccagaccgggauccagcgcacggucuucuucgugcugaugaugcugguggcccccuccuacggcaugcggugcgucggcguggggaaccgcgacuucguggagggcgucagcgggggcgcguggguggaccucgugcuggagcacggcgggugcgucaccaccauggcccagggcaagcccacccuggacuucgagcucacgaagaccaccgccaaggagguggcccugcugcggaccuacugcaucgaggcccucaucuccaacaucacgaccgcgacccgcugcccgacccagggggagcccuaccugaaggaggagcaggaccagcaguacaucugccggcgcgacguggucgaccggggcugggggaacggcugcggccuguucgggaagggcgggguggugacgugcgccaaguucagcugcuccggcaagaucaccgggaaccucguccagaucgagaaccuggaguacaccgugguggucaccgugcacaacggcgacacgcacgccgucggcaacgacaccagcaaccacggggugaccgccaccaucacgccccgcucccccagcguggaggucaagcugccggacuacggcgagcucacccuggacugcgagccccgguccgggaucgacuucaacgagaugauccugaugaagaugaagaagaagaccuggcucgugcacaagcagugguuccuggaccugccccuccccuggaccaccggcgccgacacgagcgaggugcacuggaacuacaaggagcgcauggucaccuucaaggugccgcacgcgaagcggcaggacgugaccguccuggggucccaggagggcgccaugcacagcgcccuggccggcgccaccgagguggacagcggggacggcaaccacauguucgcggggcaccucaagugcaaggugcgcauggagaagcugcgcaucaagggcauguccuacacgaugugcagcggcaaguucuccaucgacaaggagauggccgagacccagcacgggaccaccgucgugaaggugaaguacgagggcgccggggcccccugcaagguccccaucgagauccgggacgugaacaaggagaagguggucggccgcgugaucagcgccacgccccuggcggagaacaccaacuccgugaccaacaucgagcucgagccgcccuucggggacagcuacaucgucaucggcgugggcaacuccgcccugacccugcacugguuccggaaggggagcuccaucggcaagauguucgagagcacguaccgcggggccaagcggauggccauccucggcgagaccgcgugggacuucggguccgugggcggccuguucaccagccuggggaaggccguccaccagguguucggcuccguguacaccacgauguucgggggcgucagcuggaugauccgcauccucaucggguuccuggugcuguggaucggcaccaacucccggaacaccagcauggccaugaccugcaucgccgugggcgggaucacgcuguuccucggcuucaccguccaggccgacauggggugcgugguguccuggagcggccgcgagcugaagugcggguccggcaucuucgucguggacaacgugcacaccuggaccgagcaguacaaguuccagcccgagagccccgcgcggcuggccagcgccauccucaacgcccacaaggacggcgucugcgggauccgcuccacgacccggcuggagaacgugauguggaagcagaucaccaacgagcugaacuacgugcucugggagggcgggcacgaccugaccgucguggccggcgacgugaagggcguccugacgaaggggaagcgcgcgcucaccccgcccgccagcgaccugaaguacuccuggaagaccuggggcaaggccaagaucuucacccccgaggcccggaacagcacguuccugaucgacgggcccgacaccuccgagugcccgaacgagcgccgggccuggaacagcuucgagguggaggacuacggcuucgggauguucaccaccaacaucuggaugaaguuccgcgagggcuccagcgaggugugcgaccaccggcucauguccgcggccaucaaggaccagaaggccguccacgccgacaugggcuacuggaucgagagcuccaagaaccagacguggcagaucgagcgcgcgagccugaucgaggugaagaccugccuguggcccaagacccacacccucugguccaacggggugcuggagagccagaugcugauccccaaguccuacgccggcccguucagccagcacaacuaccggcagggguacgccacccagacggucggccccuggcaccucgggaagcuggagaucgacuucggcgagugccccggcaccaccgugaccauccaggagaacugcgaccaccgcgggcccucccugcgcacgaccaccgccagcggcaagcucgugacccaguggugcugccggagcugcacgaugccgccccugcgcuuccugggggaggacggcugcugguacgggauggagauccggccccucuccgagaaggaggagaacauggucaagagccaggugaccgccggccagggcaccuccgagaccuucagcauggggcugcugugccucacgcuguucgucgaggagugccugcgccggcgcgugacccggaagcacaugauccucgcgguggucaucacccugugcgccaucauccugggcgggcucaccuggauggaccugcugcgcgcccucaucaugcugggcgacacgauguccggccggaucgggggccagacccaccuggccaucaucgccguguucaagaugagccccggguacgugcucggcgucuuccugcgcaagcugaccucccgggagaccgcgcucauggugaucgggauggccaugacgaccacccugagcaucccgcacgaccugauggagcucaucgacggcaucucccugggccugauccuccugaagaucgugacccaguucgacaacacgcaggucgggacccuggcccucagccugaccuucauccgcuccaccaugagccuggugauggccuggcggacgaucauggccgugcucuucgucgugacccugaucccccugugccgcaccuccugccuccagaagcagagccacuggguggagaucaccgcgcugauccugggcgcccaggcccuccccgucuaccugaugacgcugaugaagggggccucccggcgcagcuggccccucaacgagggcaucauggcgguggggcuggugucccugcucggcagcgcccugcugaagaacgacgucccgcucgccggccccaugguggccgggggccugcugcucgccgcguacgugauguccgggagcagcgccgaccugucccuggagaaggccgccaacguccagugggacgagauggccgacaucaccggcagcucccccaucaucgaggugaagcaggacgaggacgggagcuucuccauccgggacguggaggagaccaacaugaucacccuccuggucaagcuggcgcucaucacggugagcggccuguacccccuggccaucccgaucaccaugacccucugguacauguggcaggugaagacccagcgcuccggcgcccugugggacguccccagccccgccgccacccagaaggcggcccuguccgaggggguguaccggaucaugcagcgcggccucuucgggaagacgcaggugggcgucgggauccacauggagggcguguuccacaccauguggcacgugacccggggcagcgucaucugccacgagaccgggcgccuggagcccuccugggccgacgugcgcaacgacaugaucagcuacggcgggggcuggcggcugggcgacaagugggacaaggaggaggacgugcagguccucgccaucgagccggggaagaaccccaagcacgugcagacgaagcccggccuguucaagacccugaccggggagaucggcgccgugacccucgacuucaagcccgggacguccggcagcccgaucaucaaccgcaagggcaaggucaucgggcuguacggcaacgggguggugaccaaguccggcgacuacgucagcgcgaucacccaggccgagcggaucggggagcccgacuacgagguggacgaggacaucuuccgcaagaagcggcugaccaucauggaccuccaccccggcgccggcaagacgaagcgcauccugccguccaucgugcgggaggcccugaagcgccggcugcgcacccucauccuggcgcccacccgggucguggccgccgagauggaggaggcccugcgcgggcuccccauccgguaccagacccccgccgugaagagcgagcacacgggccgcgagaucgucgaccugaugugccacgcgaccuucaccacccggcugcucuccagcacgcgcgugccgaacuacaaccugaucgugauggacgaggcccacuucaccgaccccagcuccgucgccgcccggggguacaucagcacccgcguggagaugggcgaggccgcggccaucuucaugaccgccacgccccccggggccaccgacccguucccccaguccaacagccccaucgaggacaucgagcgggagauccccgagcgcuccuggaacaccggcuucgacuggaucaccgacuaccagggcaagacggucugguucgugccgagcaucaaggccgggaacgacaucgcgaacugccugcgcaaguccggcaagaaggugauccagcucagccggaagaccuucgacaccgaguaccccaagaccaagcugacggacugggacuucgucgugaccaccgacaucuccgagaugggggccaacuuccgcgccggccgggugaucgacccccgccggugccugaagcccgucauccucaccgacgggccggagcgcgugauccuggccggccccauccccgugacgcccgcgagcgccgcccagcggcgcggccggaucgggcgcaacccggcccaggaggacgaccaguacgucuucuccggcgacccccugaagaacgacgaggaccacgcccacuggaccgaggcgaagaugcuccuggacaacaucuacacccccgaggggaucauccccacccuguucggcccggagcgggagaagacgcaggccaucgacggcgaguuccgccuccggggggagcagcgcaagaccuucguggagcugaugcggcgcggcgaccugcccguguggcucagcuacaaggucgccuccgccgggaucagcuacaaggaccgggaguggugcuucaccggcgagcgcaacaaccagauccuggaggagaacauggagguggagaucuggacccgggagggggagaagaagaagcugcgccccaaguggcucgacgcccggguguacgcggaccccauggcccugaaggacuucaaggaguucgccuccggccgcaagagcaucacccuggacauccucacggagaucgccucccugccgaccuaccugagcucccgcgccaagcucgcgcuggacaacaucgucaugcugcacaccaccgagcggggcgggcgcgccuaccagcacgcccucaacgagcugcccgagagccuggagacgcucaugcugguggcccugcucggcgcgaugaccgccgggaucuuccuguucuucaugcagggcaaggggaucggcaagcugagcaugggccucaucaccaucgccguggccuccgggcugcugugggucgccgagauccagccccaguggaucgcggccagcaucauccucgaguucuuccugauggugcugcucaucccggagcccgagaagcagcggaccccccaggacaaccagcugaucuacgugauccugacgauccucaccaucaucggccugaucgccgccaacgagauggggcugaucgagaagaccaagaccgacuucggcuucuaccaggucaagacggagaccaccauccucgacguggaccugcgccccgccuccgcguggacccuguacgccguggccacgaccauccucaccccgaugcugcggcacaccaucgagaacacgagcgccaaccugucccucgccgcgaucgccaaccaggccgccguccugauggggcugggcaagggcuggccccuccaccgcauggaccugggggugccccugcucgccaugggcugcuacagccaggugaaccccaccacccugaccgcgucccuggucaugcuccuggugcacuacgccaucaucgggccgggccugcaggccaaggccacgcgggaggcgcagaagcgcaccgccgccggcaucaugaagaaccccaccguggacgggaucaccgucaucgaccucgagcccaucagcuacgaccccaaguucgagaagcagcugggccaggugaugcugcucgugcugugcgccgggcagcugcuccugaugcggacgaccugggccuucugcgagguccugacccucgcgaccggcccgauccugacgcugugggaggggaaccccggccgcuucuggaacaccaccaucgccguguccaccgccaacaucuuccggggcagcuaccucgccggggccggccuggcguucucccugaucaagaacgcccagacgccccgccgggggaccggcaccgccggggagacccucggcgagaaguggaagcgccagcugaacagccuggaccggaaggaguucgaggaguacaagcgcuccggcauccucgagguggaccggaccgaggccaagagcgcccugaaggacggguccaagaucaagcacgcggucagccgcggcuccagcaagauccgguggaucguggagcgcgggauggugaagcccaagggcaaggucguggaccuggggugcggccgcggcgggugguccuacuacauggccacgcucaagaacgugaccgaggucaagggcuacaccaaggggggcccggggcacgaggagcccauccccauggccaccuacggcuggaaccuggugaagcugcacagcggcguggacgucuucuacaagcccacggagcagguggacacccuccugugcgacaucggggagagcuccagcaacccgaccaucgaggagggccggacccugcgcgugcucaagauggucgagcccuggcuguccagcaagcccgaguucugcaucaaggugcugaaccccuacaugccgacggugaucgaggagcuggagaagcuccagcggaagcacgggggcaaccugguccgcugcccccugucccggaacagcacccacgagauguacuggguguccggcgccagcgggaacaucgucuccagcgugaacaccaccuccaagaugcuccugaaccgcuucacgacccggcaccgcaagcccaccuacgagaaggacguggaccugggcgcggggacccggagcgucuccacggagaucgagaagcccgacaugaccaucaucggccgccggcuccagcgccugcaggaggagcacaaggagaccuggcacuacgaccaggagaacccguaccggaccugggccuaccacgggagcuacgaggcccccuccacgggcagcgccuccagcauggugaacggcguggucaagcugcucaccaagcccugggacgugaucccgauggugacccagcuggccaugaccgacacgacccccuucgggcagcagcgcgucuucaaggagaagguggacacccggaccccccagcccaagccgggcacgcgcauggugaugaccaccaccgcgaacuggcugugggcccuccuggggaagaagaagaacccccggcugugcacgcgcgaggaguucaucuccaagguccggagcaacgccgccaucggcgccguguuccaggaggagcagggguggaccagcgcguccgaggccgugaacgacagccgcuucugggagcucgucgacaaggagcgggcccugcaccaggagggcaagugcgaguccugcguguacaacaugaugggcaagcgcgagaagaagcugggggaguucggccgcgccaaggggagccgggccaucugguacauguggcucggcgcgcgcuuccuggaguucgaggcccugggguuccucaacgaggaccacugguucggccgggagaacuccuggagcggcguggagggggagggccugcaccgccugggguacauccucgaggagaucgacaagaaggacggcgaccugauguacgccgacgacaccgccggcugggacacccggaucacggaggacgaccugcagaacgaggagcucaucaccgagcagauggcgccccaccacaagauccuggccaaggccaucuucaagcugaccuaccagaacaaggucgugaaggugcuccgccccaccccgcggggggccgucauggacaucaucucccgcaaggaccagcggggcagcgggcaggugggcaccuacgggcugaacacguucaccaacauggaggugcagcugauccgccagauggaggccgagggcgucaucacccaggacgacaugcagaaccccaagggccucaaggagcggguggagaaguggcugcgcgagugcgggguggaccggcugaagcgcauggcgaucuccggcgacgacugcgucgugaagccccucgacgagcgguucgggaccagccugcuguuccucaacgacaugggcaaggugcgcaaggacaucccccagugggagccguccaagggguggaagaacuggcaggagguccccuucugcagccaccacuuccacaagaucuucaugaaggacggccggucccugguggugcccugccgcaaccaggacgagcugaucggccgggcccgcaucagccagggggccggcuggucccuccgcgagacggccugccuggggaaggccuacgcgcagauguggagccugauguacuuccaccggcgcgaccuccggcuggccuccauggccaucugcagcgccguccccaccgagugguucccgaccagccgcaccacgugguccauccacgcccaccaccaguggaugaccaccgaggacaugcugaagguguggaaccggguguggaucgaggacaaccccaacaugaucgacaagacccccguccacagcugggaggacauccccuaccucggcaagcgcgaggaccuguggugcgggucccugaucggccucagcucccgggcgacgugggccaagaacauccacaccgccaucacccaggugcgcaaccugaucggcaaggaggaguacguggacuacaugagcgucaugaagcgguacuccgccccgagcgaguccgagggggugcuguga

SEQ ID NO: 10518 - RNA, 9867 nt, Artificial Sequence
  derived and/or modified CDS sequence (opt1) from DENV-4__KJ579241__SS-prME
agcaccaucacccugcucugccugauccccacggugauggccuuccaccuguccacccgcgacggcgagccgcucaugaucgucgccaagcacgagcgggggcgcccccugcuguucaagaccaccgagggcaucaacaagugcacgcucaucgcgauggaccugggggagaugugcgaggacaccgugaccuacaagugcccccugcucgugaacaccgagcccgaggacaucgacugcuggugcaaccugacgagcaccugggucauguacggcaccugcacccaguccggggagcggcgccgggagaagcgcagcguggcccugacgccgcacuccggcaugggccucgagacccgggccgagaccuggaugagcuccgagggggccuggaagcacgcccagcgcguggagagcuggauccugcggaaccccggcuucgcgcugcucgccggguucauggccuacaugaucggccagaccgggauccagcgcacggucuucuucgugcugaugaugcugguggcccccuccuacggcaugcggugcgucggcguggggaaccgcgacuucguggagggcgucagcgggggcgcguggguggaccucgugcuggagcacggcgggugcgucaccaccauggcccagggcaagcccacccuggacuucgagcucacgaagaccaccgccaaggagguggcccugcugcggaccuacugcaucgaggcccucaucuccaacaucacgaccgcgacccgcugcccgacccagggggagcccuaccugaaggaggagcaggaccagcaguacaucugccggcgcgacguggucgaccggggcugggggaacggcugcggccuguucgggaagggcgggguggugacgugcgccaaguucagcugcuccggcaagaucaccgggaaccucguccagaucgagaaccuggaguacaccgugguggucaccgugcacaacggcgacacgcacgccgucggcaacgacaccagcaaccacggggugaccgccaccaucacgccccgcucccccagcguggaggucaagcugccggacuacggcgagcucacccuggacugcgagccccgguccgggaucgacuucaacgagaugauccugaugaagaugaagaagaagaccuggcucgugcacaagcagugguuccuggaccugccccuccccuggaccaccggcgccgacacgagcgaggugcacuggaacuacaaggagcgcauggucaccuucaagaucccgcacgcgaagcggcaggacgugaccgugcuggggucccaggagggcgccaugcacagcgcccuggccggcgccaccgaggucgacagcggggacggcaaccacauguucgcggggcaccucaagugcaaggugcgcauggagaagcugcgcaucaagggcauguccuacacgaugugcagcggcaaguucuccaucgacaaggagauggccgagacccagcacgggaccaccguggucaaggugaaguacgagggcgccggggcccccugcaaggugcccaucgagauccgggacgucaacaaggagaagguggugggccgcgucaucagcgccacgccccuggcggagaacaccaacuccgugaccaacaucgagcucgagccgcccuucggggacagcuacaucgugaucggcgucggcaacuccgcccugacccugcacugguuccggaaggggagcuccaucggcaagauguucgagagcacguaccgcggggccaagcggauggccauccucggcgagaccgcgugggacuucggguccgugggcggccuguucaccagccuggggaaggccgugcaccaggucuucggcuccguguacaccacgauguucgggggcgugagcuggaugauccgcauccucaucggguuccugguccuguggaucggcaccaacucccggaacaccagcauggccaugaccugcaucgccgugggcgggaucacgcuguuccucggcuucaccgugcaggccgacauggggugcgucguguccuggagcggccgcgagcugaagugcggguccggcaucuucguggucgacaacgugcacaccuggaccgagcaguacaaguuccagcccgagagccccgcgcggcuggccagcgccauccucaacgcccacaaggacggcgugugcgggauccgcuccacgacccggcuggagaacgucauguggaagcagaucaccaacgagcugaacuacgugcucugggagggcgggcacgaccugaccguggucgccggcgacgugaagggcgugcugacgaaggggaagcgcgcgcucaccccgcccgccagcgaccugaaguacuccuggaagaccuggggcaaggccaagaucuucacccccgaggcccggaacagcacguuccugaucgacgggcccgacaccuccgagugcccgaacgagcgccgggccuggaacagcuucgaggucgaggacuacggcuucgggauguucaccaccaacaucuggaugaaguuccgcgagggcuccagcgaggugugcgaccaccggcucauguccgcggccaucaaggaccagaaggccgugcacgccgacaugggcuacuggaucgagagcuccaagaaccagacguggcagaucgagcgcgcgagccugaucgaggucaagaccugccuguggcccaagacccacacccucugguccaacggggugcuggagagccagaugcugauccccaaguccuacgccggcccguucagccagcacaacuaccggcagggguacgccacccagacggugggccccuggcaccucgggaagcuggagaucgacuucggcgagugccccggcaccaccgucaccauccaggagaacugcgaccaccgcgggcccucccugcgcacgaccaccgccagcggcaagcucgugacccaguggugcugccggagcugcacgaugccgccccugcgcuuccugggggaggacggcugcugguacgggauggagauccggccccucuccgagaaggaggagaacauggugaagagccaggucaccgccggccagggcaccuccgagaccuucagcauggggcugcugugccucacgcuguucguggaggagugccugcgccggcgcgucacccggaagcacaugauccucgcgguggugaucacccugugcgccaucauccugggcgggcucaccuggauggaccugcugcgcgcccucaucauccugggcgacacgauguccggccggaucgggggccagacccaccuggccaucauggccgucuucaagaugagccccggguacgugcucggcguguuccugcgcaagcugaccucccgggagaccgcgcucauggucaucgggauggccaugacgaccacccugagcaucccgcacgaccugauggagcucaucgacggcaucucccugggccugauccuccugaagaucgugacccaguucgacaacacgcagguggggacccuggcccucagccugaccuucauccgcuccaccaugagccuggucauggccuggcggacgaucauggccgugcucuucguggucacccugaucccccugugccgcaccuccugccuccagaagcagagccacuggguggagaucaccgcgcugauccugggcgcccaggcccuccccguguaccugaugacgcugaugaagggggccucccggcgcagcuggccccucaacgagggcaucauggcggucgggcuggugucccugcucggcagcgcccugcugaagaacgacgugccgcucgccggccccauggucgccgggggccugcugcucgccgcguacgugauguccgggagcagcgccgaccugucccuggagaaggccgccaacgugcagugggacgagauggccgacaucaccggcagcucccccaucaucgaggucaagcaggacgaggacgggagcuucuccauccgggacguggaggagaccaacaugaucacccuccuggugaagcuggcgcucaucacggucagcggccuguacccccuggccaucccgaucaccaugacccucugguacauguggcaggugaagacccagcgcuccggcgcccugugggacgugcccagccccgccgccacccagaaggcggcccuguccgagggggucuaccggaucaugcagcgcggccucuucgggaagacgcaggugggcguggggauccacauggagggcgucuuccacaccauguggcacgugacccggggcagcgugaucugccacgagaccgggcgccuggagcccuccugggccgacguccgcaacgacaugaucagcuacggcgggggcuggcggcugggcgacaagugggacaaggaggaggacgugcaggugcucgccaucgagccggggaagaaccccaagcacguccagacgaagcccggccuguucaagacccugaccggggagaucggcgccgugacccucgacuucaagcccgggacguccggcagcccgaucaucaaccgcaagggcaaggugaucgggcuguacggcaacggggucgugaccaaguccggcgacuacgugagcgcgaucacccaggccgagcggaucggggagcccgacuacgaggucgacgaggacaucuuccgcaagaagcggcugaccaucauggaccuccaccccggcgccggcaagacgaagcgcauccugccguccaucgugcgggaggcccugaagcgccggcugcgcacccucauccuggcgcccacccggguggucgccgccgagauggaggaggcccugcgcgggcuccccauccgguaccagacccccgccgugaagagcgagcacacgggccgcgagaucguggaccugaugugccacgcgaccuucaccacccggcugcucuccagcacgcgcgucccgaacuacaaccugaucgugauggacgaggcccacuucaccgaccccagcuccguggccgcccggggguacaucagcacccgcgucgagaugggcgaggccgcggccaucuucaugaccgccacgccccccggggccaccgacccguucccccaguccaacagccccaucgaggacaucgagcgggagauccccgagcgcuccuggaacaccggcuucgacuggaucaccgacuaccagggcaagacggugugguucgucccgagcaucaaggccgggaacgacaucgcgaacugccugcgcaaguccggcaagaaggugauccagcucagccggaagaccuucgacaccgaguaccccaagaccaagcugacggacugggacuucguggucaccaccgacaucuccgagaugggggccaacuuccgcgccggccgggugaucgacccccgccggugccugaagcccgugauccucaccgacgggccggagcgcgucauccuggccggccccauccccgugacgcccgcgagcgccgcccagcggcgcggccggaucgggcgcaacccggcccaggaggacgaccaguacguguucuccggcgacccccugaagaacgacgaggaccacgcccacuggaccgaggcgaagaugcuccuggacaacaucuacacccccgaggggaucauccccacccuguucggcccggagcgggagaagacgcaggccaucgacggcgaguuccgccuccggggggagcagcgcaagaccuucgucgagcugaugcggcgcggcgaccugcccguguggcucagcuacaagguggccuccgccgggaucagcuacaaggaccgggaguggugcuucaccggcgagcgcaacaaccagauccuggaggagaacauggaggucgagaucuggacccgggagggggagaagaagaagcugcgccccaaguggcucgacgcccggguguacgcggaccccauggcccugaaggacuucaaggaguucgccuccggccgcaagagcaucacccuggacauccucacggagaucgccucccugccgaccuaccugagcucccgcgccaagcucgcgcuggacaacaucgugaugcugcacaccaccgagcggggcgggcgcgccuaccagcacgcccucaacgagcugcccgagagccuggagacgcucaugcuggucgcccugcucggcgcgaugaccgccgggaucuuccuguucuucaugcagggcaaggggaucggcaagcugagcaugggccucaucaccaucgccguggccuccgggcugcuguggguggccgagauccagccccaguggaucgcggccagcaucauccucgaguucuuccugaugguccugcucaucccggagcccgagaagcagcggaccccccaggacaaccagcugaucuacgugauccugacgauccucaccaucaucggccugaucgccgccaacgagauggggcugaucgagaagaccaagaccgacuucggcuucuaccaggugaagacggagaccaccauccucgacgucgaccugcgccccgccuccgcguggacccuguacgccguggccacgaccauccucaccccgaugcugcggcacaccaucgagaacacgagcgccaaccugucccucgccgcgaucgccaaccaggccgccgugcugauggggcugggcaagggcuggccccuccaccgcauggaccugggggucccccugcucgccaugggcugcuacagccaggugaaccccaccacccugaccgcgucccuggugaugcuccugguccacuacgccaucaucgggccgggccugcaggccaaggccacgcgggaggcgcagaagcgcaccgccgccggcaucaugaagaaccccaccguggacgggaucaccgugaucgaccucgagcccaucagcuacgaccccaaguucgagaagcagcugggccaggucaugcugcucgugcugugcgccgggcagcugcuccugaugcggacgaccugggccuucugcgaggugcugacccucgcgaccggcccgauccugacgcugugggaggggaaccccggccgcuucuggaacaccaccaucgccgucuccaccgccaacaucuuccggggcagcuaccucgccggggccggccuggcguucucccugaucaagaacgcccagacgccccgccgggggaccggcaccgccggggagacccucggcgagaaguggaagcgccagcugaacagccuggaccggaaggaguucgaggaguacaagcgcuccggcauccucgagguggaccggaccgaggccaagagcgcccugaaggacggguccaagaucaagcacgcggugagccgcggcuccagcaagauccgguggaucgucgagcgcgggauggugaagcccaagggcaagguggucgaccuggggugcggccgcggcgggugguccuacuacauggccacgcucaagaacgugaccgaggugaagggcuacaccaaggggggcccggggcacgaggagcccauccccauggccaccuacggcuggaaccuggucaagcugcacagcggcguggacguguucuacaagcccacggagcaggucgacacccuccugugcgacaucggggagagcuccagcaacccgaccaucgaggagggccggaccaugcgcgugcugaagaugguggagcccuggcucuccagcaagcccgaguucugcaucaagguccugaaccccuacaugccgacggugaucgaggagcuggagaagcugcagcggaagcacgggggcaaccucgugcgcugcccccugucccggaacagcacccacgagauguacugggucuccggcgccagcgggaacaucguguccagcgucaacaccaccuccaagaugcugcucaaccgcuucacgacccggcaccgcaagcccaccuacgagaaggacguggaccugggcgcggggacccggagcguguccacggagaccgagaagcccgacaugaccaucaucggccgccggcugcagcgccuccaggaggagcacaaggagaccuggcacuacgaccaggagaacccguaccggacgugggccuaccacgggagcuacgaggcccccuccaccggcagcgccuccagcauggucaacggcguggugaagcugcugaccaagcccugggacgucaucccgauggugacccagcucgccaugacggacaccacccccuucgggcagcagcgcguguucaaggagaaggucgacacccggacgccccagcccaagccgggcacccgcauggugaugaccaccacggcgaacuggcugugggcccugcucgggaagaagaagaacccccggcugugcacccgcgaggaguucaucuccaaggugcggagcaacgccgccaucggcgccgucuuccaggaggagcagggguggaccagcgcguccgaggccgugaacgacagccgcuucugggagcugguggacaaggagcgggcccuccaccaggagggcaagugcgaguccugcgucuacaacaugaugggcaagcgcgagaagaagcugggggaguucggccgcgccaaggggagccgggccaucugguacauguggcugggcgcgcgcuuccucgaguucgaggcccugggguuccugaacgaggaccacugguucggccgggagaacuccuggagcggcguggagggggagggccuccaccgccugggguacauccuggaggagaucgacaagaaggacggcgaccucauguacgccgacgacaccgccggcugggacacgcggaucaccgaggacgaccugcagaacgaggagcugaucaccgagcagauggcgccccaccacaagauccucgccaaggccaucuucaagcugaccuaccagaacaagguggucaaggugcugcgccccaccccgcggggggccgugauggacaucaucucccgcaaggaccagcggggcagcgggcaggucggcacguacgggcucaacaccuucaccaacauggaggugcagcugauccgccagauggaggccgagggcgugaucacccaggacgacaugcagaaccccaagggccugaaggagcgggucgagaaguggcuccgcgagugcgggguggaccggcugaagcgcauggcgaucuccggcgacgacugcguggucaagccccuggacgagcgguucgggacgagccuccuguuccugaacgacaugggcaaggugcgcaaggacaucccccagugggagccguccaagggguggaagaacuggcaggaggugcccuucugcagccaccacuuccacaagaucuucaugaaggacggccggucccucgucgugcccugccgcaaccaggacgagcugaucggccgggcccgcaucagccagggggccggcuggucccugcgcgagaccgccugccucgggaaggccuacgcgcagauguggagccugauguacuuccaccggcgcgaccugcggcucgccuccauggccaucugcagcgccgugcccaccgagugguucccgaccagccgcacgaccugguccauccacgcccaccaccaguggaugaccaccgaggacaugcugaaggucuggaaccggguguggaucgaggacaaccccaacaugaucgacaagacgcccgugcacagcugggaggacauccccuaccugggcaagcgcgaggaccucuggugcgggucccugaucggccugagcucccgggcgaccugggccaagaacauccacaccgccaucacccagguccgcaaccucaucggcaaggaggaguacguggacuacaugccggugaugaagcgguacagcgcccccuccgagagcgaggggguccuguga

SEQ ID NO: 10519 - RNA, 9867 nt, Artificial Sequence
  derived and/or modified CDS sequence (opt1) from DENV-4__KJ596672__SS-prME
agcaccaucacccugcucugccugauccccacggugauggccuuccaccuguccacccgcgacggcgagccgcucaugaucgucgccaagcacgagcgggggcgcccccugcuguucaagaccaccgagggcaucaacaagugcacgcucaucgcgauggaccugggggagaugugcgaggacaccgugaccuacaagugcccccugcucgugaacaccgagcccgaggacaucgacugcuggugcaaccugacgagcaccugggucauguacggcaccugcacccaguccggggagcggcgccgggagaagcgcagcguggcccugacgccgcacuccggcaugggccucgagacccgggccgagaccuggaugagcuccgagggggccuggaagcacgcccagcgcguggagagcuggauccugcggaaccccggcuucgcgcugcucgccggguucauggccuacaugaucggccagaccgggauccagcgcacggucuucuucgugcugaugaugcugguggcccccuccuacggcaugcggugcgucggcguggggaaccgcgacuucguggagggcgucagcgggggcgcguggguggaccucgugcuggagcacggcgggugcgucaccaccauggcccagggcaagcccacccuggacuucgagcucacgaagaccaccgccaaggagguggcccugcugcggaccuacugcaucgaggcccucaucuccaacaucacgaccgcgacccgcugcccgacccagggggagcccuaccugaaggaggagcaggaccagcaguacaucugccggcgcgacguggucgaccggggcugggggaacggcugcggccuguucgggaagggcgggguggugacgugcgccaaguucagcugcuccggcaagaucaccgggaaccucguccagaucgagaaccuggaguacaccgugguggucaccgugcacaacggcgacacgcacgccgucggcaacgacaccagcaaccacggggugaccgccaccaucacgccccgcucccccagcguggaggucaagcugccggacuacggcgagcucacccuggacugcgagccccgguccgggaucgacuucaacgagaugauccugaugaagaugaagaagaagaccuggcucgugcacaagcagugguuccuggaccugccccuccccuggaccaccggcgccgacacgagcgaggugcacuggaacuacaaggagcgcauggucaccuucaaggugccgcacgcgaagcggcaggacgugaccguccuggggucccaggagggcgccaugcacagcgcccuggccggcgccaccgagguggacagcggggacggcaaccacauguucgcggggcaccucaagugcaaggugcgcauggagaagcugcgcaucaagggcauguccuacacgaugugcagcggcaaguucuccaucgacaaggagauggccgagacccagcacgggaccaccgucgugaaggugaaguacgagggcgccggggcccccugcaagguccccaucgagauccgggacgugaacaaggagaagguggucggccgcgugaucagcgccacgccccuggcggagaacaccaacuccgugaccaacaucgagcucgagccgcccuucggggacagcuacaucgucaucggcgugggcaacuccgcccugacccugcacugguuccggaaggggagcuccaucggcaagauguucgagagcacguaccgcggggccaagcggauggccauccucggcgagaccgcgugggacuucggguccgugggcggccuguucaccagccuggggaaggccguccaccagguguucggcuccguguacaccacgauguucgggggcgucagcuggaugauccgcauccucaucggguuccuggugcuguggaucggcaccaacucccggaacaccagcauggccaugaccugcaucgccgugggcgggaucacgcuguuccucggcuucaccguccaggccgacauggggugcgugguguccuggagcggccgcgagcugaagugcggguccggcaucuucgucguggacaacgugcacaccuggaccgagcaguacaaguuccagcccgagagccccgcgcggcuggccagcgccauccucaacgcccacaaggacggcgucugcgggauccgcuccacgacccggcuggagaacgugauguggaagcagaucaccaacgagcugaacuacgugcucugggagggcgggcacgaccugaccgucguggccggcgacgugaagggcguccugacgaaggggaagcgcgcgcucaccccgcccgccagcgaccugaaguacuccuggaagaccuggggcaaggccaagaucuucacccccgaggcccggaacagcacguuccugaucgacgggcccgacaccuccgagugcccgaacgagcgccgggccuggaacagcuucgagguggaggacuacggcuucgggauguucaccaccaacaucuggaugaaguuccgcgagggcuccagcgaggugugcgaccaccggcucauguccgcggccaucaaggaccagaaggccguccacgccgacaugggcuacuggaucgagagcuccaagaaccagacguggcagaucgagcgcgcgagccugaucgaggugaagaccugccuguggcccaagacccacacccucugguccaacggggugcuggagagccagaugcugauccccaaguccuacgccggcccguucagccagcacaacuaccggcagggguacgccacccagacggucggccccuggcaccucgggaagcuggagaucgacuucggcgagugccccggcaccaccgugaccauccaggagaacugcgaccaccgcgggcccucccugcgcacgaccaccgccagcggcaagcucgugacccaguggugcugccggagcugcacgaugccgccccugcgcuuccugggggaggacggcugcugguacgggauggagauccggccccucuccgagaaggaggagaacauggucaagagccaggugaccgccggccagggcaccuccgagaccuucagcauggggcugcugugccucacgcuguucgucgaggagugccugcgccggcgcgugacccggaagcacaugauccucgcgguggucaucacccugugcgccaucauccugggcgggcucaccuggauggaccugcugcgcgcccucaucaugcugggcgacacgauguccggccggaucgggggccagacccaccuggccaucaucgccguguucaagaugagccccggguacgugcucggcgucuuccugcgcaagcugaccucccgggagaccgcgcucauggugaucgggauggccaugacgaccacccugagcaucccgcacgaccugauggagcucaucgacggcaucucccugggccugauccuccugaagaucgugacccaguucgacaacacgcaggucgggacccuggcccucagccugaccuucauccgcuccaccaugagccuggugauggccuggcggacgaucauggccgugcucuucgucgugacccugaucccccugugccgcaccuccugccuccagaagcagagccacuggguggagaucaccgcgcugauccugggcgcccaggcccuccccgucuaccugaugacgcugaugaagggggccucccggcgcagcuggccccucaacgagggcaucauggcgguggggcuggugucccugcucggcagcgcccugcugaagaacgacgucccgcucgccggccccaugguggccgggggccugcugcucgccgcguacgugauguccgggagcagcgccgaccugucccuggagaaggccgccaacguccagugggacgagauggccgacaucaccggcagcucccccaucaucgaggugaagcaggacgaggacgggagcuucuccauccgggacguggaggagaccaacaugaucacccuccuggucaagcuggcgcucaucacggugagcggccuguacccccuggccaucccgaucaccaugacccucugguacauguggcaggugaagacccagcgcuccggcgcccugugggacguccccagccccgccgccacccagaaggcggcccuguccgaggggguguaccggaucaugcagcgcggccucuucgggaagacgcaggugggcgucgggauccacauggagggcguguuccacaccauguggcacgugacccggggcagcgucaucugccacgagaccgggcgccuggagcccuccugggccgacgugcgcaacgacaugaucagcuacggcgggggcuggcggcugggcgacaagugggacaaggaggaggacgugcagguccucgccaucgagccggggaagaaccccaagcacgugcagacgaagcccggccuguucaagacccugaccggggagaucggcgccgugacccucgacuucaagcccgggacguccggcagcccgaucaucaaccgcaagggcaaggucaucgggcuguacggcaacgggguggugaccaaguccggcgacuacgucagcgcgaucacccaggccgagcggaucggggagcccgacuacgagguggacgaggacaucuuccgcaagaagcggcugaccaucauggaccuccaccccggcgccggcaagacgaagcgcauccugccguccaucgugcgggaggcccugaagcgccggcugcgcacccucauccuggcgcccacccgggucguggccgccgagauggaggaggcccugcgcgggcuccccauccgguaccagacccccgccgugaagagcgagcacacgggccgcgagaucgucgaccugaugugccacgcgaccuucaccacccggcugcucuccagcacgcgcgugccgaacuacaaccugaucgugauggacgaggcccacuucaccgaccccagcuccaucgccgcccggggguacaucagcacccgcgucgagaugggcgaggccgcggccaucuucaugaccgccacgccccccggggccaccgacccguucccccaguccaacagccccaucgaggacaucgagcgggagauccccgagcgcuccuggaacaccggcuucgacuggaucaccgacuaccagggcaagacggugugguucgucccgagcaucaaggccgggaacgacaucgcgaacugccugcgcaaguccggcaagaaggugauccagcucagccggaagaccuucgacaccgaguaccccaagaccaagcugacggacugggacuucguggucaccaccgacaucuccgagaugggggccaacuuccgcgccggccgggugaucgacccccgccggugccugaagcccgugauccucaccgacgggccggagcgcgucauccuggccggccccauccccgugacgcccgcgagcgccgcccagcggcgcggccggaucgggcgcaacccggcccaggaggacgaccaguacguguucuccggcgacccccugaagaacgacgaggaccacgcccacuggaccgaggcgaagaugcuccuggacaacaucuacacccccgaggggaucauccccacccuguucggcccggagcgggagaagacgcaggccaucgacggcgaguuccgccuccggggggagcagcgcaagaccuucgucgagcugaugcggcgcggcgaccugcccguguggcucagcuacaagguggccuccgccgggaucagcuacaaggaccgggaguggugcuucaccggcgagcgcaacaaccagauccuggaggagaacauggaggucgagaucuggacccgggagggggagaagaagaagcugcgccccaaguggcucgacgcccggguguacgcggaccccauggcccugaaggacuucaaggaguucgccuccggccgcaagagcaucacccuggacauccucacggagaucgccucccugccgaccuaccugagcucccgcgccaagcucgcgcuggacaacaucgugaugcugcacaccaccgagcggggcgggcgcgccuaccagcacgcccucaacgagcugcccgagagccuggagacgcucaugcuggucgcccugcucggcgcgaugaccgccgggaucuuccuguucuucaugcagggcaaggggaucggcaagcugagcaugggccucaucaccaucgccguggccuccgggcugcuguggguggccgagauccagccccaguggaucgcggccagcaucauccucgaguucuuccugaugguccugcucaucccggagcccgagaagcagcggaccccccaggacaaccagcugaucuacgugauccugacgauccucaccaucaucggccugaucgccgccaacgagauggggcugaucgagaagaccaagaccgacuucggcuucuaccaggugaagacggagaccaccauccucgacgucgaccugcgccccgccuccgcguggacccuguacgccguggccacgaccauccucaccccgaugcugcggcacaccaucgagaacacgagcgccaaccugucccucgccgcgaucgccaaccaggccgccgugcugauggggcugggcaagggcuggccccuccaccgcauggaccugggggucccccugcucgccaugggcugcuacagccaggugaaccccaccacccugaccgcgucccuggugaugcuccugguccacuacgccaucaucgggccgggccugcaggccaaggccacgcgggaggcgcagaagcgcaccgccgccggcaucaugaagaaccccaccguggacgggaucaccgugaucgaccucgagcccaucagcuacgaccccaaguucgagaagcagcugggccaggucaugcugcucgugcugugcgccgggcagcugcuccugaugcggacgaccugggccuucugcgaggugcugacccucgcgaccggcccgauccugacgcugugggaggggaaccccggccgcuucuggaacaccaccaucgccgucuccaccgccaacaucuuccggggcagcuaccucgccggggccggccuggcguucucccugaucaagaacgcccagacgccccgccgggggaccggcaccgccggggagacccucggcgagaaguggaagcgccagcugaacagccuggaccggaaggaguucgaggaguacaagcgcuccggcauccucgagguggaccggaccgaggccaagagcgcccugaaggacggguccaagaucaagcacgcggugagccgcggcuccagcaagauccgguggaucgucgagcgcgggauggugaagcccaagggcaagguggucgaccuggggugcggccgcggcgggugguccuacuacauggccacgcucaagaacgugaccgaggugaagggcuacaccaaggggggcccggggcacgaggagcccauccccauggccaccuacggcuggaaccuggucaagcugcacagcggcguggacguguucuacaagcccacggagcaggucgacacccuccugugcgacaucggggagagcuccagcaacccgaccaucgaggagggccggacccugcgcgugcucaagaugguggagcccuggcuguccagcaagcccgaguucugcaucaagguccugaaccccuacaugccgacggugaucgaggagcuggagaagcuccagcggaagcacgggggcaaccuggugcgcugcccccugucccggaacagcacccacgagauguacugggucuccggcgccagcgggaacaucguguccagcgucaacaccaccuccaagaugcuccugaaccgcuucacgacccggcaccgcaagcccaccuacgagaaggacguggaccugggcgcggggacccggagcguguccacggagaucgagaagcccgacaugaccaucaucggccgccggcuccagcgccugcaggaggagcacaaggagaccuggcacuacgaccaggagaacccguaccggaccugggccuaccacgggagcuacgaggcccccuccacgggcagcgccuccagcauggucaacggcguggugaagcugcucaccaagcccugggacgucaucccgauggugacccagcuggccaugaccgacacgacccccuucgggcagcagcgcguguucaaggagaaggucgacacccggaccccccagcccaagccgggcacgcgcauggugaugaccaccaccgcgaacuggcugugggcccuccuggggaagaagaagaacccccggcugugcacgcgcgaggaguucaucuccaaggugcggagcaacgccgccaucggcgccgucuuccaggaggagcagggguggaccagcgcguccgaggccgugaacgacagccgcuucugggagcucguggacaaggagcgggcccugcaccaggagggcaagugcgaguccugcgucuacaacaugaugggcaagcgcgagaagaagcugggggaguucggccgcgccaaggggagccgggccaucugguacauguggcucggcgcgcgcuuccuggaguucgaggcccugggguuccucaacgaggaccacugguucggccgggagaacuccuggagcggcguggagggggagggccugcaccgccugggguacauccucgaggagaucgacaagaaggacggcgaccugauguacgccgacgacaccgccggcugggacacccggaucacggaggacgaccugcagaacgaggagcucaucaccgagcagauggcgccccaccacaagauccuggccaaggccaucuucaagcugaccuaccagaacaagguggucaaggugcuccgccccaccccgcggggggccgugauggacaucaucucccgcaaggaccagcggggcagcgggcaggucggcaccuacgggcugaacacguucaccaacauggaggugcagcugauccgccagauggaggccgagggcgugaucacccaggacgacaugcagaaccccaagggccucaaggagcgggucgagaaguggcugcgcgagugcgggguggaccggcugaagcgcauggcgaucuccggcgacgacugcguggucaagccccucgacgagcgguucgggaccagccugcuguuccucaacgacaugggcaaggugcgcaaggacaucccccagugggagccguccaagggguggaagaacuggcaggaggugcccuucugcagccaccacuuccacaagaucuucaugaaggacggccggucccuggucgugcccugccgcaaccaggacgagcugaucggccgggcccgcaucagccagggggccggcuggucccuccgcgagacggccugccuggggaaggccuacgcgcagauguggagccugauguacuuccaccggcgcgaccuccggcuggccuccauggccaucugcagcgccgugcccaccgagugguucccgaccagccgcaccacgugguccauccacgcccaccaccaguggaugaccaccgaggacaugcugaaggucuggaaccggguguggaucgaggacaaccccaacaugaucgacaagacccccgugcacagcugggaggacauccccuaccucggcaagcgcgaggaccuguggugcgggucccugaucggccucagcucccgggcgacgugggccaagaacauccacaccgccaucacccagguccgcaaccugaucggcaaggaggaguacguggacuacaugagcgugaugaagcgguacuccgccccgagcgaguccgaggggguccuguga

SEQ ID NO: 10520 - RNA, 9867 nt, Artificial Sequence
  derived and/or modified CDS sequence (opt1) from DENV-4__KJ579242__SS-prME
agcaccaucacccugcucugccugauccccacggugauggccuuccaccuguccacccgcgacggcgagccgcucaugaucgucgccaagcacgagcgggggcgcccccugcuguucaagaccaccgagggcaucaacaagugcacgcucaucgcgauggaccugggggagaugugcgaggacaccgugaccuacaagugcccccugcucgugaacaccgagcccgaggacaucgacugcuggugcaaccugacgagcaccugggucauguacggcaccugcacccaguccggggagcggcgccgggagaagcgcagcguggcccugacgccgcacuccggcaugggccucgagacccgggccgagaccuggaugagcuccgagggggccuggaagcacgcccagcgcguggagagcuggauccugcggaaccccggcuucgcgcugcucgccggguucauggccuacaugaucggccagaccgggauccagcgcacggucuucuucgugcugaugaugcugguggcccccuccuacggcaugcggugcgucggcguggggaaccgcgacuucguggagggcgucagcgggggcgcguggguggaccucgugcuggagcacggcgggugcgucaccaccauggcccagggcaagcccacccuggacuucgagcucacgaagaccaccgccaaggagguggcccugcugcggaccuacugcaucgaggcccucaucuccaacaucacgaccgcgacccgcugcccgacccagggggagcccuaccugaaggaggagcaggaccagcaguacaucugccggcgcgacguggucgaccggggcugggggaacggcugcggccuguucgggaagggcgggguggugacgugcgccaaguucagcugcuccggcaagaucaccgggaaccucguccagaucgagaaccuggaguacaccgugguggucaccgugcacaacggcgacacgcacgccgucggcaacgacaccagcaaccacggggugaccgccaccaucacgccccgcucccccagcguggaggucaagcugccggacuacggcgagcucacccuggacugcgagccccgguccgggaucgacuucaacgagaugauccugaugaagaugaagaagaagaccuggcucgugcacaagcagugguuccuggaccugccccuccccuggaccaccggcgccgacacgagcgaggugcacuggaacuacaaggagcgcauggucaccuucaaggugccgcacgcgaagcggcaggacgugaccguccuggggucccaggagggcgccaugcacagcgcccuggccggcgccaccgagguggacagcggggacggcaaccacauguucgcggggcaccucaagugcaaggugcgcauggagaagcugcgcaucaagggcauguccuacacgaugugcagcggcaaguucuccaucgacaaggagauggccgagacccagcacgggaccaccgucgugaaggugaaguacgagggcgccggggcccccugcaagguccccaucgagauccgggacgugaacaaggagaagguggucggccgcgugaucagcgccacgccccuggcggagaacaccaacuccgugaccaacaucgagcucgagccgcccuucggggacagcuacaucgucaucggcgugggcaacuccgcccugacccugcacugguuccggaaggggagcuccaucggcaagauguucgagagcacguaccgcggggccaagcggauggccauccucggcgagaccgcgugggacuucggguccgugggcggccuguucaccagccuggggaaggccguccaccagguguucggcuccguguacaccacgauguucgggggcgucagcuggaugauccgcauccucaucggguuccuggugcuguggaucggcaccaacucccggaacaccagcauggccaugaccugcaucgccgugggcgggaucacgcuguuccucggcuucaccguccaggccgacauggggugcgugguguccuggagcggccgcgagcugaagugcggguccggcaucuucgucguggacaacgugcacaccuggaccgagcaguacaaguuccagcccgagagccccgcgcggcuggccagcgccauccucaacgcccacaaggacggcgucugcgggauccgcuccacgacccggcuggagaacgugauguggaagcagaucaccaacgagcugaacuacgugcucugggagggcgggcacgaccugaccgucguggccggcgacgugaagggcguccugacgaaggggaagcgcgcgcucaccccgcccgccagcgaccugaaguacuccuggaagaccuggggcaaggccaagaucuucacccccgaggcccggaacagcacguuccugaucgacgggcccgacaccuccgagugcccgaacgagcgccgggccuggaacagcuucgagguggaggacuacggcuucgggauguucaccaccaacaucuggaugaaguuccgcgagggcuccagcgaggugugcgaccaccggcucauguccgcggccaucaaggaccagaaggccguccacgccgacaugggcuacuggaucgagagcuccaagaaccagacguggcagaucgagcgcgcgagccugaucgaggugaagaccugccuguggcccaagacccacacccucugguccaacggggugcuggagagccagaugcugauccccaaguccuacgccggcccguucagccagcacaacuaccggcagggguacgccacccagacggucggccccuggcaccucgggaagcuggagaucgacuucggcgagugccccggcaccaccgugaccauccaggagaacugcgaccaccgcgggcccucccugcgcacgaccaccgccagcggcaagcucgugacccaguggugcugccggagcugcacgaugccgccccugcgcuuccugggggaggacggcugcugguacgggauggagauccggccccucuccgagaaggaggagaacauggucaagagccaggugaccgccggccagggcaccuccgagaccuucagcauggggcugcugugccucacgcuguucgucgaggagugccugcgccggcgcgugacccggaagcacaugauccucgcgguggucaucacccugugcgccaucauccugggcgggcucaccuggauggaccugcugcgcgcccucaucauccugggcgacacgauguccggccggaucgggggccagacccaccuggccaucauggccguguucaagaugagccccggguacgugcucggcgucuuccugcgcaagcugaccucccgggagaccgcgcucauggugaucgggauggccaugacgaccacccugagcaucccgcacgaccugauggagcucaucgacggcaucucccugggccugauccuccugaagaucgugacccaguucgacaacacgcaggucgggacccuggcccucagccugaccuucauccgcuccaccaugagccuggugauggccuggcggacgaucauggccgugcucuucgucgugacccugaucccccugugccgcaccuccugccuccagaagcagagccacuggguggagaucaccgcgcugauccugggcgcccaggcccuccccgucuaccugaugacgcugaugaagggggccucccggcgcagcuggccccucaacgagggcaucauggcgguggggcuggugucccugcucggcagcgcccugcugaagaacgacgucccgcucgccggccccaugguggccgggggccugcugcucgccgcguacgugauguccgggagcagcgccgaccugucccuggagaaggccgccaacguccagugggacgagauggccgacaucaccggcagcucccccaucaucgaggugaagcaggacgaggacgggagcuucuccauccgggacguggaggagaccaacaugaucacccuccuggucaagcuggcgcucaucacggugagcggccuguacccccuggccaucccgaucaccaugacccucugguacauguggcaggugaagacccagcgcuccggcgcccugugggacguccccagccccgccgccacccagaaggcggcccuguccgaggggguguaccggaucaugcagcgcggccucuucgggaagacgcaggugggcgucgggauccacauggagggcguguuccacaccauguggcacgugacccggggcagcgucaucugccacgagaccgggcgccuggagcccuccugggccgacgugcgcaacgacaugaucagcuacggcgggggcuggcggcugggcgacaagugggacaaggaggaggacgugcagguccucgccaucgagccggggaagaaccccaagcacgugcagacgaagcccggccuguucaagacccugaccggggagaucggcgccgugacccucgacuucaagcccgggacguccggcagcccgaucaucaaccgcaagggcaaggucaucgggcuguacggcaacgggguggugaccaaguccggcgacuacgucagcgcgaucacccaggccgagcggaucggggagcccgacuacgagguggacgaggacaucuuccgcaagaagcggcugaccaucauggaccuccaccccggcgccggcaagacgaagcgcauccugccguccaucgugcgggaggcccugaagcgccggcugcgcacccucauccuggcgcccacccgggucguggccgccgagauggaggaggcccugcgcgggcuccccauccgguaccagacccccgccgugaagagcgagcacacgggccgcgagaucgucgaccugaugugccacgcgaccuucaccacccggcugcucuccagcacgcgcgugccgaacuacaaccugaucgugauggacgaggcccacuucaccgaccccagcuccgucgccgcccggggguacaucagcacccgcguggagaugggcgaggccgcggccaucuucaugaccgccacgccccccggggccaccgacccguucccccaguccaacagccccaucgaggacaucgagcgggagauccccgagcgcuccuggaacaccggcuucgacuggaucaccgacuaccagggcaagacggucugguucgugccgagcaucaaggccgggaacgacaucgcgaacugccugcgcaaguccggcaagaaggugauccagcucagccggaagaccuucgacaccgaguaccccaagaccaagcugacggacugggacuucgucgugaccaccgacaucuccgagaugggggccaacuuccgcgccggccgggugaucgacccccgccggugccugaagcccgucauccucaccgacgggccggagcgcgugauccuggccggccccauccccgugacgcccgcgagcgccgcccagcggcgcggccggaucgggcgcaacccggcccaggaggacgaccaguacgucuucuccggcgacccccugaagaacgacgaggaccacgcccacuggaccgaggcgaagaugcuccuggacaacaucuacacccccgaggggaucauccccacccuguucggcccggagcgggagaagacgcaggccaucgacggcgaguuccgccuccggggggagcagcgcaagaccuucguggagcugaugcggcgcggcgaccugcccguguggcucagcuacaaggucgccuccgccgggaucagcuacaaggaccgggaguggugcuucaccggcgagcgcaacaaccagauccuggaggagaacauggagguggagaucuggacccgggagggggagaagaagaagcugcgccccaaguggcucgacgcccggguguacgcggaccccauggcccugaaggacuucaaggaguucgccuccggccgcaagagcaucacccuggacauccucacggagaucgccucccugccgaccuaccugagcucccgcgccaagcucgcgcuggacaacaucgucaugcugcacaccaccgagcggggcgggcgcgccuaccagcacgcccucaacgagcugcccgagagccuggagacgcucaugcugguggcccugcucggcgcgaugaccgccgggaucuuccuguucuucaugcagggcaaggggaucggcaagcugagcaugggccucaucaccaucgccguggccuccgggcugcugugggucgccgagauccagccccaguggaucgcggccagcaucauccucgaguucuuccugauggugcugcucaucccggagcccgagaagcagcggaccccccaggacaaccagcugaucuacgugauccugacgauccucaccaucaucggccugaucgccgccaacgagauggggcugaucgagaagaccaagaccgacuucggcuucuaccaggucaagacggagaccaccauccucgacguggaccugcgccccgccuccgcguggacccuguacgccguggccacgaccauccucaccccgaugcugcggcacaccaucgagaacacgagcgccaaccugucccucgccgcgaucgccaaccaggccgccguccugauggggcugggcaagggcuggccccuccaccgcauggaccugggggugccccugcucgccaugggcugcuacagccaggugaaccccaccacccugaccgcgucccuggucaugcuccuggugcacuacgccaucaucgggccgggccugcaggccaaggccacgcgggaggcgcagaagcgcaccgccgccggcaucaugaagaaccccaccguggacgggaucaccgucaucgaccucgagcccaucagcuacgaccccaaguucgagaagcagcugggccaggugaugcugcucgugcugugcgccgggcagcugcuccugaugcggacgaccugggccuucugcgagguccugacccucgcgaccggcccgauccugacgcugugggaggggaaccccggccgcuucuggaacaccaccaucgccguguccaccgccaacaucuuccggggcagcuaccucgccggggccggccugguguucucccugaucaagaacgcgcagacgccccgccgggggaccggcaccgccggggagacccucggcgagaaguggaagcgccagcugaacagccuggaccggaaggaguucgaggaguacaagcgcuccggcauccucgaggucgaccggaccgaggccaagagcgcccugaaggacggguccaagaucaagcacgccgugagccgcggcuccagcaagauccgguggaucguggagcgcgggauggucaagcccaagggcaaggugguggaccuggggugcggccgcggcgggugguccuacuacauggcgacgcucaagaacgucaccgaggugaagggcuacaccaaggggggcccggggcacgaggagcccauccccauggccaccuacggcuggaaccuggugaagcugcacagcggcgucgacguguucuacaagcccacggagcagguggacacccuccugugcgacaucggggagagcuccagcaacccgaccaucgaggagggccggaccaugcgcguccugaagaugguggagcccuggcucuccagcaagcccgaguucugcaucaaggugcugaaccccuacaugccgacggucaucgaggagcuggagaagcugcagcggaagcacgggggcaaccucgugcgcugcccccugucccggaacagcacccacgagauguacugggucuccggcgccagcgggaacaucguguccagcgugaacaccaccuccaagaugcugcucaaccgcuucacgacccggcaccgcaagcccaccuacgagaaggacgucgaccugggcgccgggacccggagcguguccacggagaccgagaagcccgacaugaccaucaucggccgccggcugcagcgccuccaggaggagcacaaggagaccuggcacuacgaccaggagaacccguaccggacgugggcguaccacgggagcuacgaggcccccuccaccggcagcgccuccagcauggugaacggcgucgugaagcugcugaccaagcccugggacgugaucccgauggucacccagcucgccaugacggacaccacccccuucgggcagcagcgcguguucaaggagaagguggacacccggacgccccagcccaagccgggcacccgcauggucaugaccaccacggccaacuggcugugggcgcugcucgggaagaagaagaacccccggcugugcacccgcgaggaguucaucuccaaggugcggagcaacgccgccaucggcgccguguuccaggaggagcagggguggaccagcgccuccgaggcggucaacgacagccgcuucugggagcugguggacaaggagcgggcccuccaccaggagggcaagugcgaguccugcguguacaacaugaugggcaagcgcgagaagaagcugggggaguucggccgcgccaaggggagccgggccaucugguacauguggcugggcgcccgcuuccucgaguucgaggcgcugggguuccugaacgaggaccacugguucggccgggagaacuccuggagcggcgucgagggggagggccuccaccgccugggguacauccuggaggagaucgacaagaaggacggcgaccucauguacgccgacgacaccgccggcugggacacgcggaucaccgaggacgaccugcagaacgaggagcugaucaccgagcagauggccccccaccacaagauccucgcgaaggccaucuucaagcugaccuaccagaacaagguggugaagguccugcgccccaccccgcggggggccgugauggacaucaucucccgcaaggaccagcggggcagcgggcaggugggcacguacgggcucaacaccuucaccaacauggagguccagcugauccgccagauggaggccgagggcgugaucacccaggacgacaugcagaaccccaagggccugaaggagcggguggagaaguggcuccgcgagugcggggucgaccggcugaagcgcauggccaucuccggcgacgacugcguggugaagccccuggacgagcgguucgggacgagccuccuguuccugaacgacaugggcaagguccgcaaggacaucccccagugggagccguccaagggguggaagaacuggcaggaggugcccuucugcagccaccacuuccacaagaucuucaugaaggacggccggucccucgugguccccugccgcaaccaggacgagcugaucggccgggcgcgcaucagccagggggccggcuggucccugcgcgagaccgccugccucgggaaggccuacgcccagauguggagccugauguacuuccaccggcgcgaccugcggcucgcguccauggccaucugcagcgccgugcccaccgagugguucccgaccagccgcacgaccugguccauccacgcccaccaccaguggaugaccaccgaggacaugcugaagguguggaaccgggucuggaucgaggacaaccccaacaugaucgacaagacgcccgugcacagcugggaggacauccccuaccugggcaagcgcgaggaccucuggugcgggucccugaucggccugagcucccgggccaccugggcgaagaacauccacaccgccaucacccaggugcgcaaccucaucggcaaggaggaguacgucgacuacaugccggugaugaagcgguacagcgcccccuccgagagcgagggggugcuguga

SEQ ID NO: 10521 - RNA, 9867 nt, Artificial Sequence
  derived and/or modified CDS sequence (opt1) from DENV-4__GQ398256__SS-prME
agcaccaugacccugcucugccugauccccaccgugauggccuuccaccugagcacccgcgacggcgagccgcucaugaucguggccaagcacgagcgggggcgcccccugcuguucaagaccaccgagggcaucaacaagugcacgcucaucgcgauggaccugggggagaugugcgaggacaccgugaccuacaagugcccccugcucgugaacaccgagcccgaggacaucgacugcuggugcaaccugacgagcaccugggugauguacgggaccugcacccagaacggggagcggcgccgggagaagcgcuccguggcccugacgccgcacagcggcaugggccucgagacccgggccgagaccuggauguccagcgagggggccuggaagcacgcccagcgcguggaguccuggauccugcggaaccccggcuucgcgcugcucgccggguucauggccuacaugaucggccagaccgggauccagcgcacggucuucuucgugcugaugaugcugguggcccccagcuacggcaugcggugcgucggcguggggaaccgcgacuucguggagggcgucuccgggggcgcguggguggaccucgugcuggagcacggcgggugcgucaccaccauggcccagggcaagcccacccuggacuucgagcucacgaagaccaccgccaaggagguggcccugcugcggaccuacugcaucgaggccagcaucuccaacaucacgaccgcgacccgcugcccgacccagggggagcccuaccucaaggaggagcaggaccagcaguacaucugccggcgcgacguggucgaccggggcugggggaacggcugcggccuguucgggaagggcgggguggugacgugcgccaaguuccugugcagcggcaagaucaccgggaaccucguccagaucgagaaccuggaguacaccguggccgugaccguccacaacggcgacacgcacgccgugggcaacgacaccuccagccacggggucaccgccaccaucacgccccgcucccccagcguggaggugaagcugccggacuacggcgagcucacccuggacugcgagccccgguccgggaucgacuucaacgagaugauccugaugaagaugaagaagaagaccuggcucguccacaagcagugguuccuggaccugccccuccccuggaccgcgggcgccgacaccagcgaggugcacuggaaccacaaggagcgcauggugacguucaaggucccgcacgccaagcggcaggacgugaccgugcuggggucccaggagggcgccaugcacagcgcccuggcgggcgccaccgaggucgacagcggggacggcaaccacauguucgccgggcaccucaagugcaaggugcgcauggagaagcugcgcaucaagggcauguccuacaccaugugcagcggcaaguucuccaucgacaaggagauggccgagacgcagcacgggaccaccguggucaaggugaaguacgagggcgccggggcgcccugcaaggugcccaucgagauccgggacgucaacaaggagaagguggugggccgcaucaucagcuccacccccuucgccgagaacacgaacagcgucaccaacaucgagcuggagccgcccuucggggacuccuacaucgugaucggcgugggcgagagcgcccucacccugcacugguuccggaagggguccagcaucggcaagauguucgaguccaccuaccgcggggccaagcggauggcgauccugggcgagacggccugggacuucgggagcgucggcggccucuucaccucccuggggaaggccgugcaccagguguucggcagcgucuacaccaccauguucgggggcguguccuggauggugcgcauccugaucggguuccucguccuguggaucggcacgaacagccggaacaccuccauggccaugaccugcaucgccgugggcgggaucacccuguuccugggcuucacggugcaggcggacauggggugcgucgugagcuggaacggcaaggagcucaagugcggguccggcaucuucguggucgacaacgugcacaccuggaccgagcaguacaaguuccagcccgagagccccgcccgccuggccagcgccauccugaacgcccacaaggacggcgugugcgggauccgguccaccacgcgccucgagaacgucauguggaagcagaucaccaacgagcugaacuacgugcugugggagggcgggcacgaccucaccguggucgcgggcgacgugaagggcgugcugaccaaggggaagcgggcccugacgccgcccgucaacgaccucaaguacagcuggaagaccuggggcaaggccaagaucuucacccccgaggcccgcaacuccaccuuccugaucgacgggcccgacacgagcgagugcccgaacgagcggcgcgccuggaacuucuucgagguggaggacuacggcuucgggauguucaccaccaacaucuggaugaaguuccgggagggcuccagcgaggugugcgaccaccgccugauguccgcggccaucaaggaccagaaggccguccacgccgacaugggcuacuggaucgagagcuccaagaaccagaccuggcagaucgagaaggcgagccucaucgaggugaagacgugccuguggcccaagacccacacccugugguccaacggggugcucgagagccagaugcugaucccccgguccuacgccggcccguucagccagcacaacuaccgccagggguacgccacccagaccgucggccccuggcaccuggggaagcucgagaucgacuucggcgagugccccggcacgaccguggccauccgggaggacugcgaccaccgcgggcccucccugcgcaccaccacggccagcggcaagcuggugacccaguggugcugccgguccugcaccaugccgccccuccgcuuccugggggaggacggcugcugguacgggauggagauccggccccugagcgagaaggaggagaacauggucaagagccaggugaccgcgggccagggcacguccgagaccuucagcauggggcuccugugccugacccucuucgucgaggagugccugcgccggcgcgugacccggaagcacaugauccugguggucgugaucacguucugcgccaucauccucggcgggcugaccuggauggaccugcuccgcgcccugaucaugcugggcgacaccauguccggccggaucgggggccagauccaccucgccaucauggccguguucaagaugagccccggguacguccugggcguguuccugcgcaagcucaccucccgggagacggcgcugauggugaucgggauggccaugaccaccgucuucagcaucccgcacgaccugauggagcucaucgacggcaucucccugggccugauccuccugaagaucgugacccacuucgacaacacccagguggggacccuggcccucagccugaccuuccugcgcuccaccaucccccucgucauggccuggcggacgaucauggccguguucuucguggucacccugaucccccugugccgcaccagcugccuccagaagcagucccacuggguggagaucaccgcgcugauccugggcgcccaggcccuccccguguaccugaugacgcugaugaagggggccagccggcgcuccuggccgcucaacgagggcaucauggcggucgggcuggugagccugcucggcuccgcccugcugaagaacgacgugccccucgccggccccauggucgccgggggccugcugcucgccgcguacgugaugagcggguccagcgccgaccugucccuggagaaggccgccaacgugcagugggacgagauggccgacaucaccggcagcagccccaucaucgaggucaagcaggacgaggacggguccuucagcauccgggacguggaggagaccaacaugaucacccuccuggugaagcuggcgcucaucacggucuccggccuguacccgcuggccauccccgugaccauggcccucugguacaucuggcaggucaagacccagcgcagcggcgcccugugggacguccccucccccgccgcgacccagaaggccacgcugagcgaggggguguaccggaucaugcagcgcggccucuucgggaagacccaggugggcgucgggauccacauggagggcguguuccacaccauguggcacgugacccggggcuccgucaucugccacgagaccgggcgccuggagccgagcugggccgacgugcgcaacgacaugaucuccuacggcgggggcuggcggcugggcgacaagugggacaaggaggaggacgugcagguccucgccaucgagcccgggaagaaccccaagcacgugcagacgaagcccggccuguucaagacccugaccggggagaucggcgccgugacccucgacuucaagccggggacgagcggcucccccaucaucaacaagaagggcaaggucaucgggcuguacggcaacgggguggugaccaagagcggcgacuacgucuccgcgaucacccaggccgagcgcaucggggagcccgacuacgagguggacgaggacaucuuccggaagaagcgccugaccaucauggaccuccacccgggcgccggcaagacgaagcggauccugcccagcaucgugcgcgaggcccugaagcggcgccuccggacccugauccuggcgcccacccgcgucguggccgccgagauggaggaggcccugcgggggcuccccauccgcuaccagaccccggccgugaaguccgagcacacgggccgggagaucgucgaccugaugugccacgcgaccuucaccacccgccugcucagcuccacgcgggugcccaacuacaaccugaucgucauggacgaggcccacuucaccgaccccugcagcguggccgcccgcggguacaucuccacccggguggagaugggcgaggccgcggccaucuucaugaccgccacgcccccgggggccaccgaccccuucccccagagcaacagccccaucgaggacaucgagcgcgagaucccggagcgguccuggaacaccggcuucgacuggaucaccgacuaccagggcaagacggucugguucgugcccagcaucaaggccgggaacgacaucgcgaacugccugcgcaaguccggcaagcgcgugauccagcucagccggaagaccuucgacaccgaguaccccaagaccaagcugacggacugggacuucgucgugaccaccgacaucuccgagaugggggccaacuuccgcgccggccgggugaucgacccccgccggugccugaagccggucauccucaccgacgggcccgagcgcgugauccuggccggccccauccccgugacgccggcgagcgccgcccagcggcgcggccggaucgggcgcaaccccgcccaggaggacgaccaguacgucuucuccggcgacccccugaagaacgacgaggaccacgcccacuggaccgaggcgaagaugcuccuggacaacaucuacacccccgaggggaucaucccgacccuguucggccccgagcgggagaagacgcaggccaucgacggcgaguuccgccuccgcggggagcagcgcaagaccuucguggagcugaugaagcggggcgaccugcccguguggcucagcuacaaggucgccuccgccgggaucagcuacaaggaccgcgaguggugcuucaccggcgagcggaacaaccagauccuggaggagaacauggagguggagaucuggaccaaggagggggagaagaagaagcugcgccccaaguggcucgacgcccggguguacgcggacccgauggcccugaaggacuucaaggaguucgccuccggccgcaagagcaucacgcuggacauccucaccgagaucgccucccugcccaccuaccugagcuccaaggccaagcucgcgcuggacaacaucgucaugcugcacaccaccgagaagggcgggcgggccuaccagcacgcccucaacgagcugcccgagagccuggagacgcucaugcugguggcccugcucggcgcgaugaccgccgggaucuuccuguucuucaugcagggcaaggggaucggcaagcuguccaugggccucaucgccaucgccguggccagcgggcugcugugggucgcggagauccagccgcaguggaucgccgccuccaucauccucgaguucuuccugauggugcugcucauccccgagcccgagaagcagcgcacgccccaggacaaccagcugaucuacgugauccugaccauccucacgaucaucggccugaucgccgccaacgagauggggcugaucgagaagaccaagaccgacuucggcuucuaccaggucaagaccgagacgaccauccucgacguggaccugcgcccggcgagcgccuggacccuguacgccguggccaccacgauccucacccccaugcugcggcacaccaucgagaacaccagcgccaaccugucccucgcggccaucgccaaccaggccgccguccugauggggcugggcaagggcuggccccuccaccgcauggaccugggggugccccugcucgcgaucggcugcuacagccaggugaacccgacgacccugaccgccucccuggucaugcuccuggugcacuacgccaucaucgggcccggccugcaggccaaggcgacccgggaggcccagaagcgcacggccgccggcaucaugaagaaccccaccguggacgggaucaccgucaucgaccucgagcccaucagcuacgacccgaaguucgagaagcagcugggccaggugaugcugcucgugcugugcgucgggcagcugcuccugaugcggaccacgugggcccugugcgaggugcucacccuggcgaccggccccgccaugacccugugggaggggaaccccggccgcuucuggaacacgaccaucgccguguccaccgccaacaucuuccggggcagcuaccucgccggggcgggccuggccuucucccugaucaagaacgcccagacgccccggcgggggacgggcaccaccggggagacccucggcgagaaguggaagcgccagcugaacagccuggaccggaaggaguucgaggaguacaagcgcuccggcauccucgaggucgaccggacggaggccaagagcgcccugaaggacggguccaagaucaagcacgcggugagccgcggcuccagcaagauccgguggaucguggagcgcgggauggucaagccgaagggcaaggugguggaccuggggugcggccggggcgggugguccuacuacauggccacccucaagaacgucaccgaggugaagggcuacaccaagggcggccccgggcacgaggagcccauccccauggccaccuacggcuggaaccuggugaagcugcacagcggcgucgacguguucuacaagccgacggagcaggucgacacccuccugugcgacaucggggaguccagcuccaaccccaccaucgaggagggccgcacccugcggguccucaagaugguggagcccuggcugagcagcaagcccgaguucugcaucaagguccugaacccguacaugcccacggugaucgaggagcucgagaagcugcagcgccgcuacgggggcucccuggugcggugcccccugagccgcaacuccacccacgagauguacugggucagcggcgccuccgggaacaucgugagcuccgugaacaccaucagcaagaugcuccugaaccgguucaccacgcgccaccggaagcccaccuacgagaaggacgucgaccugggcgcggggacccgcuccgugagcaccgagacggagaagccggacaugaccgugaucggccggcgccuccagcggcugcaggaggagcacaaggagaccuggcacuacgaccaggagaaccccuaccgcaccugggccuaccacggguccuacgaggcccccagcacgggcuccgccagcuccauggucaacggcaucgugaagcugcucaccaagccgugggacgugauccccauggucacccagcuggccaugaccgacacgacccccuucgggcagcagcggguguucaaggagaagguggacacccgcacgccccagccgaagcccggcacgcggaugaucaugaccaccaccgcgaacuggcugugggcccuccuggggaagaagaaguccccgcgccugugcacgcgggaggaguucaucuccaagguccgcagcaacgccgccaucggcgccguguuccaggaggagcagggguggaccuccgcgagcgaggccgugaacgacagccgguucugggagcucgucaacaaggagcgcgcccugcaccaggagggcaagugcgaguccugcguguacaacaugaugggcaagcgggagaagaagcugggggaguucggccgcgccaaggggagccgggccaucugguacauguggcucggcgcgcgcuuccuggaguucgaggcccugggguuccucaacgaggaccacugguucucccgcgagaacagcugguccggcguggagggcgaggggcugcaccggcugggcuacauccucgaggacaucgacaagcaggacggggaccugaucuacgccgacgacaccgccggcugggacacccgcaucacggaggacgaccugcucaacgaggagcugaucaccgagcagauggcgccccaccacaagacccuggccaaggccaucuucaagcucaccuaccagaacaaggucgugaaggugcugcggcccacgcccaagggcgccgucauggacaucaucagccgcaaggaccagcggggguccggccagguggggaccuacggccugaacaccuucaccaacauggaggugcagcucauccgccagauggaggccgagggggucaucacccaggacgacaugcagaaccccaagggccugaaggagcggguggagaaguggcugacggagugcggcguggaccgccucaagcggauggcgaucagcggggacgacugcgucgugaagccccuggacgagcgcuucuccgccagccuccuguuccugaacgacaugggcaaggugcggaaggacaucccgcagugggagcccuccaagggguggaagaacuggcaggagguccccuucugcagccaccacuuccacaagaucuucaugaaggacggccgcucccugguggugcccugccggaaccaggacgagcucaucgggcgcgcccggaucagccagggcgccggcuggucccugcgcgagaccgccugccuggggaaggcguacgcccagauguggagccucauguacuuccaccggcgcgaccugcggcuggccuccauggccaucugcagcgccgucccgaccgagugguuccccaccagccgcacgaccugguccauccacgcgcaccaccaguggaugaccaccgaggacaugcucaagguguggaaccgcguguggaucgaggacaaccccaacaugacggacaagacccccguccacagcugggaggacaucccguaccugggcaagcgggaggaccuguggugcgggucccucaucggccugagcucccgcgccaccugggccaagaacauccacaccgccaucacccaggugcggaaccugaucgggaaggaggaguacguggacuacaugcccgucaugaagcgcuacagcgcccccuccgagagcgagggcgugcucuga

SEQ ID NO: 10522 - RNA, 9867 nt, Artificial Sequence
  derived and/or modified CDS sequence (opt1) from DENV-4__KC333651__SS-prME
agcaccaugacccugcucugccugauccccaccgugauggccuuccaccugagcacccgcgacggcgagccgcucaugaucguggccaagcacgagcgggggcgcccccugcuguucaagaccaccgagggcaucaacaagugcacccucaucgcgauggaccugggggagaugugcgaggacaccgugaccuacaagugcccccugcucgugaacaccgagcccgaggacaucgacugcuggugcaaccugaccagcaccugggugauguacgggaccugcacccagaacggggagcggcgccgggagaagcgcuccguggcccugacgccgcacagcggcaugggccucgagacccgggccgagaccuggauguccagcgagggggccuggaagcacgcccagcgcguggaguccuggauccugcggaaccccggcuucgcgcugcucgccggguucauggccuacaugaucggccagaccgggauccagcgcaucgucuucuucgugcugaugaugcugguggcccccagcuacggcaugcggugcgucggcguggggaaccgcgacuucguggagggcgucuccgggggcgcguggguggaccucgugcuggagcacggcgggugcgucacgaccauggcccagggcaagcccacccuggacuucgagcucaccaagacgaccgccaaggagguggcccugcugcggaccuacugcaucgaggccagcaucuccaacaucaccacggcgacccgcugcccgacccagggggagcccuaccucaaggaggagcaggaccagcaguacaucugccggcgcgacguggucgaccggggcugggggaacggcugcggccuguucgggaagggcgggguggugaccugcgccaaguuccugugcagcggcaagaucacggggaaccucguccagaucgagaaccuggaguacaccgugguggucaccgugcacaacggcgacacccacgccgucggcaacgacacguccaaccacggggugaccgccaccaucacgccccggagccccuccguggaggucaagcugccggacuacggcgagcucacgcuggacugcgagccccggagcgggaucgacuucaacgagaugauccugaugaagaugaagaagaagaccuggcucgugcacaagcagugguuccuggaccugccccuccccuggaccgccggcgcggacaccuccgaggugcacuggaaccacaaggagcgcauggucaccuucaaggugccgcacgccaagcggcaggacgugacgguccuggggagccaggagggcgccaugcacuccgcccuggccggcgcgaccgagguggacagcggggacggcaaccacauguucgccgggcaccucaagugcaaggugcgcauggagaagcugcgcaucaagggcaugagcuacaccaugugcuccggcaaguucagcaucgacaaggagauggccgagacccagcacgggacgaccgucgugaaggugaaguacgagggcgccggggcccccugcaagguccccaucgagauccgggacgugaacaaggagaagguggucggccgcaucaucuccagcacccccuucgcggagaacaccaacuccgugacgaacaucgagcuggagccgcccuucggggacagcuacaucgugaucggcgucggcgaguccgcccucacccugcacugguuccggaaggggagcuccaucggcaagauguucgagagcaccuaccgcggggccaagcggauggccauccugggcgagaccgcgugggacuucggguccgugggcggccucuucacgagccuggggaaggccgugcaccaggucuucggcuccguguacaccaccauguucgggggcgugagcuggaugguccgcauccugaucggguuccucgugcuguggaucggcaccaacucccggaacacgagcauggccaugaccugcaucgccgugggcgggaucacccuguuccugggcuucaccguccaggccgacauggggugcgugguguccuggaacggcaaggagcucaagugcgggagcggcaucuucgucguggacaacgugcacacguggaccgagcaguacaaguuccagcccgagucccccgcgcgccuggccagcgccauccugaacgcccacaaggacggcgucugcgggauccggagcaccacccgccucgagaacgugauguggaagcagaucacgaacgagcugaacuacgugcugugggagggcgggcacgaccucaccgucguggccggcgacgugaagggcguccugaccaaggggaagcgggcgcugaccccgcccgugaacgaccucaaguacuccuggaagacguggggcaaggccaagaucuucacccccgaggcccgcaacagcaccuuccugaucgacgggcccgacaccuccgagugcccgaacgagcggcgcgccuggaacuucuucgagguggaggacuacggcuucgggauguucacgaccaacaucuggaugaaguuccgggagggcagcuccgaggucugcgaccaccgccugaugagcgccgcgaucaaggaccagaaggccgugcacgccgacaugggcuacuggaucgaguccagcaagaaccagaccuggcagaucgagaaggccucccucaucgaggugaagaccugccuguggcccaagacgcacacccuguggagcaacgggguccucgagucccagaugcugaucccccggagcuacgcgggcccguucucccagcacaacuaccgccagggguacgccacccagaccgugggccccuggcaccuggggaagcucgagaucgacuucggcgagugccccggcaccacgguggccauccgggaggacugcgaccaccgcgggcccagccugcgcaccaccaccgccuccggcaagcuggucacgcaguggugcugccggagcugcaccaugccgccccuccgcuuccugggggaggacggcugcugguacgggauggagauccggccccuguccgagaaggaggagaacauggucaagagccaggucaccgccggccagggcaccagcgagacguucuccauggggcuccugugccugacccucuucguggaggagugccugcgccggcgcgugacccggaagcacaugauccuggucguggugaucaccuucugcgcgaucauccucggcgggcugacguggauggaccugcuccgcgcccugaucaugcugggcgacaccaugagcggccggaucgggggccagauccaccucgccaucauggccgucuucaagaugucccccggguacgugcugggcguguuccugcgcaagcucaccagccgggagaccgcccugauggucaucgggauggcgaugacgaccguguucuccaucccgcacgaccugauggagcucaucgacggcaucagccugggccugauccuccugaagaucgugacccacuucgacaacacccaggucgggacgcuggcccucucccugaccuuccugcgcagcaccaucccccucgugauggccuggcggaccaucauggccguguucuucgucgugacgcugaucccccugugccgcaccuccugccuccagaagcacagccacuggguggagaucaccgcccugauccugggcgcgcaggcccuccccgucuaccugaugacccugaugaagggggccucccggcgcagcuggccgcucaacgagggcaucauggccguggggcuggugucccugcucggcagcgcgcugcugaagaacgacgucccccucgccggccccaugguggccgggggccugcugcucgccgccuacgugauguccgggagcuccgcggaccugcugcucgagaaggccgccaacguccagugggacgagauggccgacaucacgggcagcucccccaucaucgaggugaagcaggacgaggacgggagcuucagcauccgggacguggaggagaccaacaugaugacccugcuggucaagcucgcccugaucaccguguccggccuguacccgcucgcgauccccgugacgauggcccugugguacaucuggcaggucaagacccagcgcagcggcgcccugugggacgugcccucccccgccgccacccagaaggcgacccucagcgaggggguguaccggaucaugcagcgcggccuguucgggaagacgcaggucggcguggggauccacauggagggcguguuccacaccauguggcacgucacccggggcuccgugaucugccacgagaccgggcgccuggagccgagcugggccgacgugcgcaacgacaugaucuccuacggcgggggcuggcggcucggcgacaagugggacaaggaggaggacguccaggugcuggccaucgagcccgggaagaaccccaagcacgugcagaccaagcccggccuguucaagacgcucaccggggagaucggcgccgucacccuggacuucaagccggggaccagcggcucccccaucaucaacaagaagggcaaggugaucgggcuguacggcaacgggguggucaccaagagcggcgacuacguguccgccaucacccaggcggagcgcaucggggagcccgacuacgagguggacgaggacaucuuccggaagaagcgccucaccaucauggaccugcacccgggcgccggcaagaccaagcggauccugcccagcaucguccgcgaggcccucaagcggcgccugcggacgcugauccuggcccccacccgcgugguggcggccgagauggaggaggcccuccgggggcugcccauccgcuaccagaccccggccgucaaguccgagcacaccggccgggagaucguggaccugaugugccacgccacguucaccacccgccuccugagcuccacccggguccccaacuacaaccugaucgugauggacgaggcgcacuucacggaccccugcagcguggccgcccgcggguacaucuccacccgggucgagaugggcgaggccgccgcgaucuucaugaccgccacgcccccgggggccacggaccccuucccccagagcaacucccccaucgaggacaucgagcgcgagaucccggagcggagcuggaacaccggcuucgacuggaucaccgacuaccagggcaagaccgugugguucgugcccagcaucaaggccgggaacgacaucgccaacugccuccgcaaguccggcaagcgcgucauccagcugagccggaagacguucgacaccgaguaccccaagaccaagcugaccgacugggacuucguggugacgaccgacaucuccgagaugggggcgaacuuccgcgccggccgggucaucgacccccgccggugccucaagccggugauccugaccgacgggcccgagcgcgugauccuggccggccccauccccgucaccccggccagcgcggcccagcggcgcggccggaucgggcgcaaccccgcccaggaggacgaccaguacguguucuccggcgacccccucaagaacgacgaggaccacgcccacuggacggaggccaagaugcugcuggacaacaucuacacccccgaggggaucaucccgacccucuucggccccgagcgggagaagacccaggcgaucgacggcgaguuccgccugcgcggggagcagcgcaagacguucguggagcugaugaagcggggcgaccuccccgucuggcugagcuacaagguggccuccgccgggaucagcuacaaggaccgcgaguggugcuucaccggcgagcggaacaaccagauccuggaggagaacauggagguggagaucuggaccaaggagggggagaagaagaagcuccgccccaaguggcuggacgcccgggucuacgccgacccgauggcgcugaaggacuucaaggaguucgccuccggccgcaagagcaucacccucgacauccugacggagaucgccucccugcccaccuaccucagcuccaaggccaagcuggcccuggacaacaucgugaugcuccacaccaccgagaagggcgggcgggcguaccagcacgcccugaacgagcugcccgagagccucgagacccugaugcugguggcccuccugggcgccaugacggcggggaucuuccuguucuucaugcagggcaaggggaucggcaagcucuccaugggccugaucgccaucgccgucgccagcgggcugcucuggguggccgagauccagccgcaguggaucgcggccuccaucauccuggaguucuuccugauggugcuccugauccccgagcccgagaagcagcgcacgccccaggacaaccagcugaucuacgucauccucaccauccugaccaucaucggccugaucgccgccaacgagauggggcucaucgagaagacgaagaccgacuucggcuucuaccaggugaagaccgagaccacgauccuggacguggaccugcgcccggccagcgcguggacccucuacgccgucgccaccaccauccugacgcccaugcugcggcacaccaucgagaacaccuccgccaaccucagccuggccgcgaucgccaaccaggccgccgugcugauggggcucggcaagggcuggccccugcaccgcauggaccugggggugccccuccuggccaucggcugcuacagccaggucaacccgaccacgcugaccgcgucccucgugaugcugcuggugcacuacgccaucaucgggcccggccuccaggccaaggccacccgggaggcgcagaagcgcaccgccgccggcaucaugaagaaccccacggucgacgggaucaccgugaucgaccuggagcccaucagcuacgacccgaaguucgagaagcagcugggccaggugaugcuccugguccugugcgccgggcagcuccugcugaugcggaccaccugggcccucugcgaggugcugacgcuggcgaccggccccgccaugacccucugggaggggaaccccggccgcuucuggaacaccacgaucgccguguccaccgccaacaucuuccggggcagcuaccuggccggggcgggccuggccuucucccucaucaagaacgcccagacgccccgccgggggaccggcacgaccggggagacccugggcgagaaguggaagcgccagcugaacagccucgaccggaaggaguucgaggaguacaagcgcuccggcauccuggaggucgaccggaccgaggccaagagcgcccugaaggacggguccaagaucaagcacgcggugagccgcggcuccagcaagauccgguggaucguggagcgcgggauggucaagccgaagggcaaggugguggaccucgggugcggccggggcgggugguccuacuacauggccacgcugaagaacgucaccgaggugaagggcuacaccaagggcggccccgggcacgaggagcccauccccauggccaccuacggcuggaaccuggugaagcuccacagcggcgucgacguguucuacaagccgaccgagcaggucgacacgcugcugugcgacaucggggaguccagcuccaaccccaccaucgaggagggccgcacccuccggguccugaagaugguggagcccuggcugagcuccaagcccgaguucugcaucaagguccucaacccguacaugcccaccgugaucgaggagcuggagaagcugcagcgccgcuacgggggcagccuggugcggugcccccucagccgcaacuccacgcacgagauguacugggucagcggcgccuccgggaacaucgugagcuccgugaacaccaucagcaagaugcugcugaaccgguucaccacccgccaccggaagcccacguacgagaaggacgucgaccucggcgcggggacccgcuccgugagcaccgagaccgagaagccggacaugacggugaucggccggcgccugcagcggcugcaggaggagcacaaggagaccuggcacuacgaccaggagaaccccuaccgcaccugggccuaccacggguccuacgaggcccccagcaccggcuccgccagcuccauggucaacggcguggugaagcuccugacgaagccgugggacgucauccccauggugacccagcuggccaugaccgacaccacgcccuucgggcagcagcggguguucaaggagaaggucgacacccgcacgccccagccgaagcccggcacccggaugaucaugacgaccaccgcgaacuggcucugggcccugcuggggaagaagaaguccccgcgccucugcacccgggaggaguucaucuccaaggugcgcagcaacgccgccaucggcgccguguuccaggaggagcagggguggacguccgcgagcgaggccgucaacgacucccgguucugggagcugguggacaaggagcgcgcccugcaccaggagggcaagugcgagagcugcguguacaacaugaugggcaagcgggagaagaagcucggggaguucggccgcgccaaggggagccgggccaucugguacauguggcugggcgcgcgcuuccuggaguucgaggcccucggguuccugaacgaggaccacugguucucccgcgagaacagcugguccggcgucgagggcgaggggcugcaccggcucggcuacauccuggaggacaucgacaagcaggagggggaccugaucuacgccgacgacaccgccggcugggacacccgcaucaccgaggacgaccuccugaacgaggagcugaucacggagcagauggcgccccaccacaagacccucgccaaggccaucuucaagcugaccuaccagaacaagguggugaagguccugcggcccacccccaagggcgccgugauggacaucaucagccgcaaggaccagcggggguccggccagguggggacguacggccucaacaccuucaccaacauggagguccagcugauccgccagauggaggccgagggggugaucacccaggacgacaugcagaaccccaagggccugaaggagcggguggagaaguggcucaccgagugcggcgucgaccgccugaagcggauggcgaucagcggggacgacugcguggugaagccccuggacgagcgcuucuccacgagccuccuguuccugaacgacaugggcaagguccggaaggacaucccgcagugggagcccuccaagggguggaagaacuggcaggaggugcccuucugcagccaccacuuccacaagaucuucaugaaggacggccgcucccucgugguccccugccggaaccaggacgagcugaucgggcgcgcccggaucagccagggcgccggcuggucccugcgcgagaccgccugccucgggaaggccuacgcgcagauguggagccugauguacuuccaccggcgcgaccugcggcucgccuccauggccaucugcagcgccgugccgaccgagugguuccccaccucccgcacgaccuggagcauccacgcccaccaccaguggaugaccaccgaggacaugcugaagguguggaaccgcgucuggaucgaggacaaccccaacaugacggacaagacccccgugcacagcugggaggacaucccguaccugggcaagcgggaggaccucuggugcgggucccugaucggccugagcucccgcgcgaccugggccaagaacauccacaccgccaucacccaggugcggaaccucaucgggaaggaggacuacgucgacuacaugcccgugaugaagcgcuacagcgcccccuccgagagcgagggcgugcuguga

SEQ ID NO: 10523 - RNA, 9867 nt, Artificial Sequence
  derived and/or modified CDS sequence (opt1) from DENV-4__JN559740__SS-prME
agcaccaucacccugcucugccugauccccaccgugauggccuuccaccuguccacccgcgacggcgagccgcucaugaucguggccaagcacgagcgggggcgcccccugcuguucaagaccaccgagggcaucaacaagugcacccucaucgcgauggaccugggggagaugugcgaggacaccgugaccuacaagugcccccugcucgugaacaccgagcccgaggacaucgacugcuggugcaaccugaccagcaccugggugauguacgggaccugcacccaguccggggagcggcgccgggagaagcgcagcguggcccugaccccgcacuccggcaugggccucgagacccgggccgagaccuggaugagcuccgagggggccuggaagcacgcccagcgcguggagagcuggauccugcggaaccccggcuucgcgcugcucgccggguucauggccuacaugaucggccagaccgggauccagcgcaccguguucuucgugcugaugaugcugguggcccccuccuacggcaugcggugcgucggcguggggaaccgcgacuucguggagggcgucagcgggggcgcguggguggaccucgugcuggagcacggcgggugcgucaccaccauggcccagggcaagcccacccuggacuucgagcucacgaagaccaccgccaaggagguggcccugcugcggaccuacugcaucgaggccuccaucagcaacaucacgaccgcgacccgcugcccgacccagggggagcccuaccucaaggaggagcaggaccagcaguacaucugccggcgcgacguggucgaccggggcugggggaacggcugcggccuguucgggaagggcgggguggugacgugcgccaaguucuccugcagcggcaagaucaccgggaaccugguccagaucgagaaccucgaguacaccgugguggucaccgugcacaacggcgacacgcgcgccgucggcaacgacaucuccaaccacggggugaccgccaugaucacgccccggagccccuccguggaggucaagcugccggacuacggcgagcugacccucgacugcgagccccgcagcgggaucgacuucaacgagaugauccugaugaagaugaagaagaagacguggcuggugcacaagcagugguuccucgaccugccccugcccuggaccgccggcgcggacaccuccgaggugcacuggaacuacaaggagcggauggucaccuucaaggugccgcacgccaagcgccaggacgugaccguccucgggagccaggagggcgccaugcacagcgcccuggccggcgcgacggagguggacuccggggacggcaaccacauguucgccgggcaccugaagugcaaggugcgcauggagaagcuccggaucaagggcaugagcuacaccaugugcuccggcaaguucagcaucgacaaggagauggccgagacccagcacgggaccacggucgugaaggugaaguacgagggcgccggggcccccugcaagguccccaucgagauccgcgacgugaacaaggagaagguggucggccggaucaucuccagcacgccccuggcggagaacaccaacuccgugaccaacaucgagcuggagccgcccuucggggacagcuacaucgugaucggcgucggcaacuccgcccucacgcugcacugguuccgcaaggggagcuccaucggcaagauguucgagagcaccuaccgcggggccaagcgcauggccauccugggcgagaccgcgugggacuucggguccgugggcggccucuucaccagccuggggaaggccgugcaccaggucuucggcuccguguacacgaccauguucgggggcgugagcuggaugauccggauccugaucggguuccucguccuguggaucggcaccaacucccgcaacaccagcauggccaugacgugcaucgccgugggcgggaucacccuguuccugggcuucaccgugcaggccgacauggggugcgucguguccuggagcggcaaggagcucaagugcgggagcggcaucuucguggucgacaacgugcacaccuggacggagcaguacaaguuccagcccgagucccccgcgcggcuggccagcgccauccugaacgcccacaaggacggcgugugcgggauccgcuccaccacccggcucgagaacgucauguggaagcagaucaccaacgagcugaacuacgugcugugggagggcgggcacgaccucacgguggucgccggcgacgugaagggcgugcugaccaaggggaagcgcgcgcugaccccgcccgucagcgaccucaaguacuccuggaagaccuggggcaaggccaagaucuucacgcccgaggcccggaacagcaccuuccugaucgacgggcccgacaccuccgagugcccgaacgagcgccgggccuggaacagccuggagguggaggacuacggcuucgggauguucaccacgaacaucuggaugaaguuccgcgagggcuccagcgaggugugcgaccaccggcucauguccgccgcgaucaaggaccagaaggccguccacgccgacaugggcuacuggaucgagagcuccaagaaccagaccuggcagaucgagaaggccagccugaucgaggugaagaccugccuguggcccaagacccacacgcucugguccaacggggugcuggagagccagaugcugauccccaaguccuacgcgggcccguucagccagcacaacuaccgccagggguacgccacccagaccgucggccccuggcaccucgggaagcuggagaucgacuucggcgagugccccggcaccaccgugacgauccaggaggacugcgaccaccgggggcccagccugcgcaccaccaccgccuccggcaagcucgugacgcaguggugcugccgcagcugcaccaugccgccccugcgguuccugggggaggacggcugcugguacgggauggagauccgcccccucuccgagaaggaggagaacauggucaagagccaggugaccgccggccagggcaccuccgagacguucagcauggggcugcugugccucacccuguucgucgaggagugccugcggcgccgggugacccgcaagcacaugauccucguggucgugaucacccugugcgccaucauccugggcgggcucacguggauggaccugcugcgggcgcucaucaugcugggcgacaccauguccggccgcaucgggggccagauccaccuggccaucauggccguguucaagaugagccccggguacguccucggcguguuccugcggaagcugaccucccgcgagaccgcccucauggugaucgggauggccaugacgaccguccugagcaucccgcacgaccugauggagcucaucgacggcaucucccugggccugauccuccugaagaucgugacccaguucgacaacacccagguggggacgcuggcgcucagccugaccuucauccgguccaccaugccccuggucauggccuggcgcaccaucauggccguccucuucguggucacgcugaucccccugugccggaccagcugccuccagaagcagucccacuggguggagaucaccgcccugauccugggcgcccaggcgcuccccguguaccugaugacccugaugaagggggccagccgccgguccuggccgcucaacgagggcaucauggccgucgggcuggugagccugcucggcuccgcccugcugaagaacgacgugccccucgcgggccccauggucgccgggggccugcugcucgccgccuacgugaugagcgggagcuccgccgaccugagccuggagaaggcggccaacgugcagugggacgagauggccgacaucacgggcuccagccccaucaucgaggucaagcaggacgaggacggguccuucagcauccgcgacguggaggagaccaacaugaucacccuccuggugaagcuggcccucaucaccgucuccggccuguacccgcuggccauccccgugacgaugacccucugguacauguggcaggucaagacccagcggagcggcgcgcugugggacguccccucccccgccgccacccagaaggccgcccugagcgaggggguguaccgcaucaugcagcggggccucuucgggaagacccaggugggcgucgggauccacauggagggcguguuccacaccauguggcacgugacccgcggcuccgucaucugccacgagaccgggcggcuggagccgagcugggcggacgugcgcaacgacaugaucuccuacggcgggggcuggcgccugggcgacaagugggacaaggaggaggacgugcagguccucgccaucgagcccgggaagaaccccaagcacgugcagaccaagcccggccuguucaagacgcugaccggggagaucggcgccgugacccucgacuucaagccggggaccagcggcucccccaucaucaaccggaagggcaaggucaucgggcuguacggcaacgggguggugaccaagagcggcgacuacgucuccgccaucacccaggccgagcgcaucggggagcccgacuacgagguggacgaggacaucuuccggaagaagcgccugaccaucauggaccuccacccgggcgcgggcaagaccaagcggauccugcccagcaucgugcgcgaggcccugaagcggcgccugcggacgcucauccuggcccccacccgcgucguggccgcggagauggaggaggcccugcgggggcuccccauccgcuaccagaccccggccgugaaguccgagcacaccggccgggagaucgucgaccugaugugccacgccacguucaccacccgccugcucagcagcacccgggugcccaacuacaaccugaucgucauggacgaggcccacuucacggaccccuccagcguggcggcccgcggguacaucuccacccggguggagaugggcgaggccgccgccaucuucaugaccgcgacgcccccgggggccacggaccccuucccccagagcaacucccccaucgaggacaucgagcgcgagaucccggagcggagcuggaacaccggcuucgacuggaucaccgacuaccagggcaagaccgucugguucgugcccuccaucaaggccgggaacgacaucgccaacugccugcgcaagagcggcaagaaggugauccagcucucccgcaagacguucgacaccgaguaccccaagaccaagcugaccgacugggacuucgucgugacgaccgacaucagcgagaugggggccaacuuccgggcgggccgcgugaucgacccccggcgcugccugaagccggucauccucaccgacgggcccgagcgggugauccuggccggccccauccccgugaccccggccuccgccgcgcagcgccggggccgcaucgggcggaaccccgcccaggaggacgaccaguacgucuucagcggcgacccccugaagaacgacgaggaccacgcccacuggacggaggccaagaugcuccuggacaacaucuacacccccgaggggaucaucccgacccuguucggccccgagcgcgagaagacccaggccaucgacggcgaguuccggcuccgcggggagcagcggaagacguucguggagcugaugcgccggggcgaccugcccguguggcucuccuacaaggucgcgagcgccgggaucuccuacaaggaccgcgaguggugcuucaccggcgagcggaacaaccagauccuggaggagaacauggagguggagaucuggacccgcgagggggagaagaagaagcugcggccccgcuggcucgacgcccggguguacgccgacccgauggcccugaaggacuucaaggaguucgcgagcggccgcaaguccaucacccuggacauccucacggagaucgccagccugcccaccuaccuguccagccgcgccaagcucgcccuggacaacaucgucaugcugcacaccaccgagcggggcgggcgcgccuaccagcacgcgcucaacgagcugcccgagagccuggagacccucaugcugguggcccugcucggcgccaugacggccgggaucuuccuguucuucaugcagggcaaggggaucggcaagcuguccaugggccucaucaccaucgcgguggccagcgggcugcugugggucgccgagauccagccgcaguggaucgccgccuccaucauccucgaguucuuccugauggugcugcucauccccgagcccgagaagcagcggacgccccaggacaaccagcugaucuacgugauccugaccauccucacgaucaucggccugaucgcggccaacgagauggggcugaucgagaagaccaagaccgacuucggcuucuaccaggucaagaccgagacgaccauccucgacguggaccugaagccggccagcgccuggacccuguacgccguggcgaccacgauccucacccccaugcugcgccacaccaucgagaacaccuccgccaaccugagccucgccgccaucgccaaccaggcggccguccugauggggcugggcaagggcuggccccuccaccggauggaccugggggugccccugcucgccaugggcugcuacucccaggugaacccgaucacgcugaccgccagccuggucaugcuccuggugcacuacgccaucaucgggcccggccugcaggcgaaggccacccgcgaggcccagaagcggaccgccgcgggcaucaugaagaaccccacgguggacgggaucaccgucaucgaccucgagcccaucuccuacgacccgaaguucgagaagcagcugggccaggugaugcugcucgugcugugcgccgggcagcugcuccugaugcgcaccaccugggccuucugcgagguccugacgcucgccaccggccccauccugacccugugggaggggaaccccggccgguucuggaacaccacgaucgccgugagcaccgcgaacaucuuccgcggcuccuaccucgccggggccggccuggccuucagccugaucaagaacgugcagacgccccggcgcgggaccggcacgaccggggagacccucggcgagaaguggaagcggcagcugaacucccuggaccgcaaggaguucgaggaguacaagcggagcggcauccucgaggucgaccgcaccgaggccaaguccgcgcugaaggacgggagcaagaucaagcacgccgugucccggggcagcuccaagauccgcuggaucguggagcgggggauggucaagccgaagggcaaggugguggaccuggggugcggccgcggcggguggagcuacuacauggccacgcucaagaacgucaccgaggugaagggcuacaccaagggcgggcccgggcacgaggagcccauccccauggccaccuacggcuggaaccuggugaagcugcacagcggcgucgacguguucuacaagccgaccgagcaggucgacacgcuccugugcgacaucggggaguccagcuccaaccccaccaucgaggagggccgcacccugcggguccucaagaugguggagcccuggcugagcuccaagcccgaguucugcaucaagguccugaacccguacaugcccaccgugaucgaggagcuggagaagcuccagcgcaagcacgggggcaaccuggugcggugcccccugagccgcaacuccacgcacgagauguacugggucagcggcgccuccgggaacaucgugagcuccgugaacaccaccagcaagaugcuccugaaccgguucaccacgcgccaccggaagcccaccuacgagaaggacgucgaccugggcgcggggacccgcuccgugagcaccgagacggagaagccggacaugaccaucaucggccggcgccuccagcggcugcaggaggagcacaaggagaccuggcacuacgaccaggagaaccccuaccgcaccugggccuaccacggguccuacgaggcccccagcacgggcuccgccagcuccauggugaacggcgucgugaagcugcucaccaagccgugggacgugauccccauggucacccagcuggcgaugaccgacacgacccccuucgggcagcagcggguguucaaggagaagguggacacccgcacgccccagccgaagcccggcacgcggauggucaugaccaccaccgccaacuggcugugggcccuccuggggaagaagaagaacccccgccugugcacgcgggaggaguucaucagcaaggugcgcagcaacgccgccaucggcgcgguguuccaggaggagcagggguggaccuccgccagcgaggccgucaacgacucccgguucugggagcucguggacaaggagcgcgcccugcaccaggagggcaagugcgagagcugcguguacaacaugaugggcaagcgggagaagaagcugggggaguucggccgcgccaaggggucccgcgcgaucugguacauguggcucggcgcccgguuccuggaguucgaggcccugggguuccucaacgaggaccacugguucggccgcgagaacagcugguccggcgucgagggggagggccugcaccggcugggguacauccucgaggagaucgacaagaaggacggcgaccugauguacgccgacgacaccgccggcugggacacccgcaucacggaggacgaccugcagaacgaggagcucaucaccgagcagauggcgccccaccacaagauccuggccaaggccaucuucaagcugaccuaccagaacaagguggugaagguccuccggccgacgccccgcggggccgugauggacaucaucagccggaaggaccagcggggcuccggccaggugggcacguacgggcugaacaccuucaccaacauggagguccagcugauccggcagauggaggcggagggcgugaucacccaggacgacaugcagaaccccaagggccucaaggagcgcguggagaaguggcugaaggagugcggggucgaccggcugaagcgcauggccaucagcggcgacgacugcguggugaagccccucgacgagcgguucgggaccucccugcuguuccucaacgacaugggcaagguccgcaaggacaucccgcagugggagcccagcaagggguggaagaacuggcaggaggugcccuucugcucccaccacuuccacaagaucuucaugaaggacggccggagccuggugguccccugccgcaaccaggacgagcugaucggccgggcccgcaucucccagggggccggcuggagccuccgggagacggccugccuggggaaggcguacgcccagauguggucccugauguacuuccaccgccgcgaccuccggcuggccagcauggccaucugcagcgccgugccgaccgagugguuccccaccucccgcaccacguggagcauccacgcgcaccaccaguggaugaccaccgaggacaugcugaagguguggaaccgggucuggaucgaggacaaccccaacaugaccgacaagacgcccgugcacuccugggaggacaucccguaccucggcaagcgcgaggaccuguggugcgggagccugaucggccucuccagccgggccaccugggccaagaacauccacaccgccaucacccaggugcgcaaccugaucggcaaggaggaguacgucgacuacaugcccgugaugaagcgguacuccgcccccagcgaguccgagggggugcuguga

SEQ ID NO: 10524 - RNA, 9867 nt, Artificial Sequence
  derived and/or modified CDS sequence (opt1) from DENV-4__JN559741__SS-prME
agcaccaucacccugcucugccugauccccacggugauggccuuccaccuguccacccgcgacggcgagccgcucaugaucgucgccaagcacgagcgggggcgcccccugcuguucaagaccaccgagggcaucaacaagugcacgcucaucgcgauggaccugggggagaugugcgaggacaccgugaccuacaagugcccccugcucgugaacaccgagcccgaggacaucgacugcuggugcaaccugacgagcaccugggucauguacggcaccugcacccaguccggggagcggcgccgggagaagcgcagcguggcccugacgccgcacuccggcaugggccucgagacccgggccgagaccuggaugagcuccgagggggccuggaagcacgcccagcgcguggagagcuggauccugcggaaccccggcuucgcgcugcucgccggguucauggccuacaugaucggccagaccgggauccagcgcacggucuucuucgugcugaugaugcugguggcccccuccuacggcaugcggugcgucggcguggggaaccgcgacuucguggagggcgucagcgggggcgcguggguggaccucgugcuggagcacggcgggugcgucaccaccauggcccagggcaagcccacccuggacuucgagcucacgaagaccaccgccaaggagguggcccugcugcggaccuacugcaucgaggcccucaucuccaacaucacgaccgcgacccgcugcccgacccagggggagcccuaccugaaggaggagcaggaccagcaguacaucugccggcgcgacguggucgaccggggcugggggaacggcugcggccuguucgggaagggcgggguggugacgugcgccaaguucagcugcuccggcaagaucaccgggaaccucguccagaucgagaaccuggaguacaccgugguggucaccgugcacaacggcgacacgcacgccgucggcaacgacaccagcaaccacggggugaccgccaccaucacgccccgcucccccagcguggaggucaagcugccggacuacggcgagcucacccuggacugcgagccccgguccgggaucgacuucaacgagaugauccugaugaagaugaagaagaagaccuggcucgugcacaagcagugguuccuggaccugccccuccccuggaccaccggcgccgacacgagcgaggugcacuggaacuacaaggagcgcauggucaccuucaaggugccgcacgcgaagcggcaggacgugaccguccuggggucccaggagggcgccaugcacagcgcccuggccggcgccaccgagguggacagcggggacggcaaccacauguucgcggggcaccucaagugcaaggugcgcauggagaagcugcgcaucaagggcauguccuacacgaugugcagcggcaaguucuccaucgacaaggagauggccgagacccagcacgggaccaccgucgugaaggugaaguacgagggcgccggggcccccugcaagguccccaucgagauccgggacgugaacaaggagaagguggucggccgcgugaucagcgccacgccccuggcggagaacaccaacuccgugaccaacaucgagcucgagccgcccuucggggacagcuacaucgucaucggcgugggcaacuccgcccugacccugcacugguuccggaaggggagcuccaucggcaagauguucgagagcacguaccgcggggccaagcggauggccauccucggcgagaccgcgugggacuucggguccgugggcggccuguucaccagccuggggaaggccguccaccagguguucggcuccguguacaccacgauguucgggggcgucagcuggaugauccgcauccucaucggguuccuggugcuguggaucggcaccaacucccggaacaccagcauggccaugaccugcaucgccgugggcgggaucacgcuguuccucggcuucaccguccaggccgacauggggugcgugguguccuggagcggccgcgagcugaagugcggguccggcaucuucgucguggacaacgugcacaccuggaccgagcaguacaaguuccagcccgagagccccgcgcggcuggccagcgccauccucaacgcccacaaggacggcgucugcgggauccgcuccacgacccggcuggagaacgugauguggaagcagaucaccaacgagcugaacuacgugcucugggagggcgggcacgaccugaccgucguggccggcgacgugaagggcguccugacgaaggggaagcgcgcgcucaccccgcccgccagcgaccugaaguacuccuggaagaccuggggcaaggccaagaucuucacccccgaggcccggaacagcacguuccugaucgacgggcccgacaccuccgagugcccgaacgagcgccgggccuggaacagcuucgagguggaggacuacggcuucgggauguucaccaccaacaucuggaugaaguuccgcgagggcuccagcgaggugugcgaccaccggcucauguccgcggccaucaaggaccagaaggccguccacgccgacaugggcuacuggaucgagagcuccaagaaccagacguggcagaucgagcgcgcgagccugaucgaggugaagaccugccuguggcccaagacccacacccucugguccaacggggugcuggagagccagaugcugauccccaaguccuacgccggcccguucagccagcacaacuaccggcagggguacgccacccagacggucggccccuggcaccucgggaagcuggagaucgacuucggcgagugccccggcaccaccgugaccauccaggagaacugcgaccaccgcgggcccucccugcgcacgaccaccgccagcggcaagcucgugacccaguggugcugccggagcugcacgaugccgccccugcgcuuccugggggaggacggcugcugguacgggauggagauccggccccucuccgagaaggaggagaacauggucaagagccaggugaccgccggccagggcaccuccgagaccuucagcauggggcugcugugccucacgcuguucgucgaggagugccugcgccggcgcgugacccggaagcacaugauccucgcgguggucaucacccugugcgccaucauccugggcgggcucaccuggauggaccugcugcgcgcccucaucaugcugggcgacacgauguccggccggaucgggggccagacccaccuggccaucauggccguguucaagaugagccccggguacgugcucggcgucuuccugcgcaagcugaccucccgggagaccgcgcucauggugaucgggauggccaugacgaccacccugagcaucccgcacgaccugauggagcucaucgacggcaucucccugggccugauccuccugaagaucgugacccaguucgacaacacgcaggucgggacccuggcccucagccugaccuucauccgcuccaccaugagccuggugauggccuggcggacgaucauggccgugcucuucgucgugacccugaucccccugugccgcaccuccugccuccagaagcagagccacuggguggagaucaccgcgcugauccugggcgcccaggcccuccccgucuaccugaugacgcugaugaagggggccucccggcgcagcuggccccucaacgagggcaucauggcgguggggcuggugucccugcucggcagcgcccugcugaagaacgacgucccgcucgccggccccaugguggccgggggccugcugcucgccgcguacgugauguccgggagcagcgccgaccugucccuggagaaggccgccaacguccagugggacgagauggccgacaucaccggcagcucccccaucaucgaggugaagcaggacgaggacgggagcuucuccauccgggacguggaggagaccaacaugaucacccuccuggucaagcuggcgcucaucacggugagcggccuguacccccuggccaucccgaucaccaugacccucugguacauguggcaggugaagacccagcgcuccggcgcccugugggacguccccagccccgccgccacccagaaggcggcccuguccgaggggguguaccggaucaugcagcgcggccucuucgggaagacgcaggugggcgucgggauccacauggagggcguguuccacaccauguggcacgugacccggggcagcgucaucugccacgagaccgggcgccuggagcccuccugggccgacgugcgcaacgacaugaucagcuacggcgggggcuggcggcugggcgacaagugggacaaggaggaggacgugcagguccucgccaucgagccggggaagaaccccaagcacgugcagacgaagcccggccuguucaagacccugaccggggagaucggcgccgugacccucgacuucaagcccgggacguccggcagcccgaucaucaaccgcaagggcaaggucaucgggcuguacggcaacgggguggugaccaaguccggcgacuacgucagcgcgaucacccaggccgagcggaucggggagcccgacuacgagguggacgaggacaucuuccgcaagaagcggcugaccaucauggaccuccaccccggcgccggcaagacgaagcgcauccugccguccaucgugcgggaggcccugaagcgccggcugcgcacccucauccuggcgcccacccgggucguggccgccgagauggaggaggcccugcgcgggcuccccauccgguaccagacccccgccgugaagagcgagcacacgggccgcgagaucgucgaccugaugugccacgcgaccuucaccacccggcugcucuccagcacgcgcgugccgaacuacaaccugaucgugauggacgaggcccacuucaccgaccccagcuccgucgccgcccggggguacaucagcacccgcguggagaugggcgaggccgcggccaucuucaugaccgccacgccccccggggccaccgacccguucccccaguccaacagccccaucgaggacaucgagcgggagauccccgagcgcuccuggaacaccggcuucgacuggaucaccgacuaccagggcaagacggucugguucgugccgagcaucaaggccgggaacgacaucgcgaacugccugcgcaaguccggcaagaaggugauccagcucagccggaagaccuucgacaccgaguaccccaagaccaagcugacggacugggacuucgucgugaccaccgacaucuccgagaugggggccaacuuccgcgccggccgggugaucgacccccgccggugccugaagcccgucauccucaccgacgggccggagcgcgugauccuggccggccccauccccgugacgcccgcgagcgccgcccagcggcgcggccggaucgggcgcaacccggcccaggaggacgaccaguacgucuucuccggcgacccccugaagaacgacgaggaccacgcccacuggaccgaggcgaagaugcuccuggacaacaucuacacccccgaggggaucauccccacccuguucggcccggagcgggagaagacgcaggccaucgacggcgaguuccgccuccggggggagcagcgcaagaccuucguggagcugaugcggcgcggcgaccugcccguguggcucagcuacaaggucgccuccgccgggaucagcuacaaggaccgggaguggugcuucaccggcgagcgcaacaaccagauccuggaggagaacauggagguggagaucuggacccgggagggggagaagaagaagcugcgccccaaguggcucgacgcccggguguacgcggaccccauggcccugaaggacuucaaggaguucgccuccggccgcaagagcaucacccuggacauccucacggagaucgccucccugccgaccuaccugagcucccgcgccaagcucgcgcuggacaacaucgucaugcugcacaccaccgagcggggcgggcgcgccuaccagcacgcccucaacgagcugcccgagagccuggagacgcucaugcugguggcccugcucggcgcgaugaccgccgggaucuuccuguucuucaugcagggcaaggggaucggcaagcugagcaugggccucaucaccaucgccguggccuccgggcugcugugggucgccgagauccagccccaguggaucgcggccagcaucauccucgaguucuuccugauggugcugcucaucccggagcccgagaagcagcggaccccccaggacaaccagcugaucuacgugauccugacgauccucaccaucaucggccugaucgccgccaacgagauggggcugaucgagaagaccaagaccgacuucggcuucuaccaggucaagacggagaccaccauccucgacguggaccugcgccccgccuccgcguggacccuguacgccguggccacgaccauccucaccccgaugcugcggcacaccaucgagaacacgagcgccaaccugucccucgccgcgaucgccaaccaggccgccguccugauggggcugggcaagggcuggccccuccaccgcauggaccugggggugccccugcucgccaugggcugcuacagccaggugaaccccaccacccugaccgcgucccuggucaugcuccuggugcacuacgccaucaucgggccgggccugcaggccaaggccacgcgggaggcgcagaagcgcaccgccgccggcaucaugaagaaccccaccguggacgggaucaccgucaucgaccucgagcccaucagcuacgaccccaaguucgagaagcagcugggccaggugaugcugcucgugcugugcgccgggcagcugcuccugaugcggacgaccugggccuucugcgagguccugacccucgcgaccggcccgauccugacgcugugggaggggaaccccggccgcuucuggaacaccaccaucgccguguccaccgccaacaucuuccggggcagcuaccucgccggggccggccuggcguucucccugaucaagaacgcccagacgccccgccgggggaccggcaccgccggggagacccucggcgagaaguggaagcgccagcugaacagccuggaccggaaggaguucgaggaguacaagcgcuccggcauccucgagguggaccggaccgaggccaagagcgcccugaaggacggguccaagaucaagcacgcggucagccgcggcuccagcaagauccgguggaucguggagcgcgggauggugaagcccaagggcaaggucguggaccuggggugcggccgcggcgggugguccuacuacauggccacgcucaagaacgugaccgaggucaagggcuacaccaaggggggcccggggcacgaggagcccauccccauggccaccuacggcuggaaccuggugaagcugcacagcggcguggacgucuucuacaagcccacggagcagguggacacccuccugugcgacaucggggagagcuccagcaacccgaccaucgaggagggccggacccugcgcgugcucaagauggucgagcccuggcuguccagcaagcccgaguucugcaucaaggugcugaaccccuacaugccgacggugaucgaggagcuggagaagcuccagcggaagcacgggggcaaccugguccgcugcccccugucccggaacagcacccacgagauguacuggguguccggcgccagcgggaacaucgucuccagcgugaacaccaccuccaagaugcuccugaaccgcuucacgacccggcaccgcaagcccaccuacgagaaggacguggaccugggcgcggggacccggagcgucuccacggagaccgagaagcccgacaugaccaucaucggccgccggcuccagcgccugcaggaggagcacaaggagaccuggcacuacgaccaggagaacccguaccggacgugggccuaccacgggagcuacgaggcccccuccaccggcagcgccuccagcauggugaacggcguggucaagcugcucaccaagcccugggacgugaucccgauggugacccagcuggccaugacggacaccacccccuucgggcagcagcgcgucuucaaggagaagguggacacccggacgccccagcccaagccgggcacccgcauggugaugaccaccacggcgaacuggcugugggcccuccuggggaagaagaagaacccccggcugugcacccgcgaggaguucaucuccaagguccggagcaacgccgccaucggcgccguguuccaggaggagcagggguggaccagcgcguccgaggccgugaacgacagccgcuucugggagcucgucgacaaggagcgggcccugcaccaggagggcaagugcgaguccugcguguacaacaugaugggcaagcgcgagaagaagcugggggaguucggccgcgccaaggggagccgggccaucugguacauguggcucggcgcgcgcuuccuggaguucgaggcccugggguuccucaacgaggaccacugguucggccgggagaacuccuggagcggcguggagggggagggccugcaccgccugggguacauccucgaggagaucgacaagaaggacggcgaccugauguacgccgacgacaccgccggcugggacacgcggaucaccgaggacgaccugcagaacgaggagcucaucaccgagcagauggcgccccaccacaagauccuggccaaggccaucuucaagcugaccuaccagaacaaggucgugaaggugcuccgccccaccccgcggggggccgucauggacaucaucucccgcaaggaccagcggggcagcgggcaggugggcacguacgggcugaacaccuucaccaacauggaggugcagcugauccgccagauggaggccgagggcgucaucacccaggacgacaugcagaaccccaagggccucaaggagcggguggagaaguggcugcgcgagugcgggguggaccggcugaagcgcauggcgaucuccggcgacgacugcgucgugaagccccucgacgagcgguucgggacgagccugcuguuccucaacgacaugggcaaggugcgcaaggacaucccccagugggagccguccaagggguggaagaacuggcaggagguccccuucugcagccaccacuuccacaagaucuucaugaaggacggccggucccugguggugcccugccgcaaccaggacgagcugaucggccgggcccgcaucagccagggggccggcuggucccuccgcgagaccgccugccuggggaaggccuacgcgcagauguggagccugauguacuuccaccggcgcgaccuccggcuggccuccauggccaucugcagcgccguccccaccgagugguucccgaccagccgcacgaccugguccauccacgcccaccaccaguggaugaccaccgaggacaugcugaagguguggaaccggguguggaucgaggacaaccccaacaugaucgacaagacgcccguccacagcugggaggacauccccuaccucggcaagcgcgaggaccuguggugcgggucccugaucggccucagcucccgggcgaccugggccaagaacauccacaccgccaucacccaggugcgcaaccugaucggcaaggaggaguacguggacuacaugccggucaugaagcgguacagcgcccccuccgagagcgagggggugcuguga

SEQ ID NO: 10525 - RNA, 9867 nt, Artificial Sequence
  derived and/or modified CDS sequence (opt1) from DENV-4__JQ513334__SS-prME
agcaccaucacccugcucugccugauccccaccgugauggccuuccaccuguccacccgcgacggcgagccccucaugaucguggccaagcacgagcgggggcgcccccugcuguucaagaccaccgagggcaucaacaagugcacccucaucgccauggaccugggggagaugugcgaggacaccgugaccuacaagugcccccugcucgugaacaccgagcccgaggacaucgacugcuggugcaaccugacgagcaccugggugauguacgggaccugcacccaguccggggagcggcgccgggagaagcgcagcguggcccugacgccgcacuccggcaugggccucgagacccgggccgagaccuggaugagcuccgagggggccuggaagcacgcccagcgcguggagagcuggauccugcggaaccccggcuucgcgcugcucgccggguucauggccuacaugaucggccagaccgggauccagcgcacggucuucuucgugcugaugaugcugguggcccccuccuacggcaugcggugcgucggcguggggaaccgcgacuucguggagggcgucagcgggggcgcguggguggaccucgugcuggagcacggcgggugcgucaccaccauggcccagggcaagcccacccuggacuucgagcucacgaagaccaccgccauggagguggcccugcugcggaccuacugcaucgaggccuccaucagcaacaucacgaccgcgacccgcugcccgacccagggggagcccuaccucaaggaggagcaggaccagcaguacaucugccggcgcgacguggucgaccggggcugggggaacggcugcggccuguucgggaagggcgggguggugacgugcgccaaguucuccugcagcgagaagaucaccggcaaccugguccagaucgagaaccucgaguacaccgugguggucaccgugcacaacggggacacgcacgccgucggcaacgacaccuccaaccacggcgugaccgccaccaucacgccccgcagccccuccguggaggucgagcugccggacuacggggagcugacccucgacugcgagccccggagcggcaucgacuucaacgagaugauccugaugaagaugaagaagaagaccuggcuggugcacaagcagugguuccucgaccugccccugcccugggccgcgggggccgacaccuccgaggugcacuggaacuacaaggagcgcauggucaccuucaaggugccgcacgccaagcggcaggacgugacgguccucggcagccaggagggggccaugcacagcgcccuggcgggcgccaccgagguggacuccggcgacgggaaccacauguucgccggccaccugaagugcaaggugcgcauggagaagcuccgcaucaaggggaugagcuacaccaugugcuccggcaaguucagcaucgacaaggagauggccgagacccagcacggcacgaccgucgugaaggugaaguacgagggggccggcgcgcccugcaagguccccaucgagauccgggacgugaacaaggagaagguggucgggcgcgugaucuccagcaucccccuggccgagaacaccaacuccgugaccaacaucgagcuggagccgcccuucggcgacagcuacaucgucaucggggugggcaacuccgcccucacgcugcacugguuccggaagggcagcuccaucgggaagauguucgagagcaccuaccgcggcgccaagcggguggcgauccugggggagaccgccugggacuucggcuccgucgggggccucuucaccagccugggcaaggccgugcaccagguguucggguccgucuacacgaccauguucggcggggugagcuggauggugcgcauccugaucggccuccugguccuguggaucgggaccaacucccggaacaccagcauggccaugacgugcaucgccgugggcggcaucacccuguuccucggguucaccgugcaggcggacaugggcugcgucguguccuggagcgggcgcgagcugaagugcggcagcgggaucuucguggucgacaacgugcacaccuggacggagcaguacaaguuccagcccgagucccccgcccggcuggccagcgccauccucaacgcccacaaggacggcgugugcggcauccgcuccaccacccggcuggagaacgucauguggaagcagaucaccaacgagcugaacuacgugcucugggagggcgggcacgaccugacgguggucgcgggggacgugaagggcgugcugaccaagggcaagcgcgcccucaccccgcccgucagcgaccugaaguacuccuggaagaccugggggaaggccaagaucuucacgcccgaggcccggaacagcaccuuccugaucgacggccccgacaccuccgagugcccgaacgagcgccgggccuggaacagccucgagguggaggacuacggguucggcauguucaccacgaacaucuggaugaaguuccgcgagggguccagcgaggugugcgaccaccggcugauguccgcggccaucaaggaccagaaggccguccacgccgacaugggcuacuggaucgagagcuccaagaaccagaccuggcagaucgagaaggcgagccugaucgaggugaagaccugccucuggcccaagacccacacgcugugguccaacggcgugcuggagagccagaugcucauccccaaguccuacgccgggccguucagccagcacaacuaccgccagggcuacgccacccagaccgucgggcccuggcaccugggcaagcuggagaucgacuucggggagugccccggcaccaccgugacgauccaggaggacugcgaccaccggggccccagccuccgcaccaccaccgccuccgggaagcuggucacgcaguggugcugccgcagcugcaccaugccgccccugcgguuccucggcgaggacgggugcugguacggcauggagauccgcccccuguccgagaaggaggagaacauggucaagagccagguggccgcggggcagggcaccuccgagaccuucagcaugggccugcucugccugacgcuguucgucgaggagugccuccggcgccgggugacccgcaagcacaugauccuggccguggucaucacccugugcgccaucauccucgggggccugaccuggauggaccugcuccgggcccugaucaugcugggggacacgauguccggccgcaucggcgggcagacccaccucgccaucauggcgguguucaagaugagccccggcuacgugcugggggucuuccugcggaagcucaccucccgcgagaccgcccugauggugaucggcauggccaugacgaccacccugagcaucccgcacgaccucauggagcugaucgacgggaucucccugggccucauccugcugaagaucgugacccaguucgacaacacgcaggucggcacccucgcccugagccugaccuucauccgguccaccaugagccucgugauggccuggcgcacgaucauggcggugcuguucgucgugacccugaucccccucugccggaccuccugccugcagaagcagagccacuggguggagaucaccgcccugauccucggggcccaggcccugcccgucuaccugaugacgcucaugaagggcgcgucccgccggagcuggccccugaacgaggggaucauggccgugggccuggugucccuccuggggagcgcccugcucaagaacgacgucccgcuggccggccccaugguggccggcgggcugcuccuggcggccuacgugaugagcggcuccagcgccgaccugucccucgagaaggccgccaacguccagugggacgagauggcggacaucaccgggagcucccccaucaucgaggugaagcaggacgaggacggcagcuucuccauccgcgacguggaggagaccaacaugaucacccugcuggucaagcucgcccugaucacggugagcgggcuguacccccucgccaucccggugaccaugacccugugguacauguggcaggucaagacccagcgguccggcgcccugugggacgugcccagccccgccgcgacgcagaaggccgcccucuccgagggcguguaccgcaucaugcagcgggggcuguucggcaagacccaggucggggugggcauccacauggaggggguguuccacaccauguggcacgucacccgcggcagcgugaucugccacgagaccggccggcuggagcccuccugggccgacgugcgcaacgacaugaucagcuacgggggcggguggcgccucggcgacaagugggacaaggaggaggacguccaggugcuggccaucgagccgggcaagaaccccaagcacgugcagacgaagcccgggcuguucaagacccucaccggcgagaucggggcggucacccuggacuucaagcccggcacguccgggagcccgaucaucaaccggaagggcaaggugaucggccuguacgggaacggcguggucaccaaguccggggacuacgugagcgccaucacccaggccgagcgcaucggcgagcccgacuacgagguggacgaggacaucuuccggaagaagcgccucaccaucauggaccugcaccccggggccggcaagacgaagcggauccugccguccaucguccgcgaggcgcugaagcggcgccuccggacccugauccuggcccccacccgcgugguggccgccgagauggaggaggcccuccggggccugcccauccgcuaccagacccccgcggucaagagcgagcacacggggcgggagaucguggaccugaugugccacgccaccuucaccacccgccuccugagcuccacgcgggucccgaacuacaaccugaucgugauggacgaggcccacuucaccgaccccagcuccguggccgcccgcggcuacaucagcacccgggucgagaugggggaggcggccgccaucuucaugaccgccacgccgcccggcgccaccgacccguucccccaguccaacagccccaucgaggacaucgagcgcgagauccccgagcgguccuggaacaccggguucgacuggaucaccgacuaccagggcaagacggugugguucgugccgagcaucaaggcgggcaacgacaucgccaacugccuccgcaaguccgggaagaaggucauccagcugagccgcaagaccuucgacaccgaguaccccaagaccaagcugacggacugggacuucguggugaccaccgacaucuccgagaugggcgccaacuuccgggccgggcgcgucaucgacccccggcgcugccucaagcccgugauccugaccgacggcccggagcgggugauccuggcggggcccauccccgucacgcccgccagcgccgcccagcgccggggccgcaucggccggaacccggcccaggaggacgaccaguacguguucuccggggacccccucaagaacgacgaggaccacgcgcacuggaccgaggccaagaugcugcuggacaacaucuacacccccgagggcaucauccccacccucuucgggccggagcgcgagaagacgcaggccaucgacggcgaguuccggcugcgcggcgagcagcggaagaccuucguggagcugaugcgccgcggggaccuccccgucuggcugagcuacaagguggccuccgccggcaucagcuacaaggaccgcgaguggugcuucaccggggagcggaacaaccagauccuggaggagaacauggagguggagaucuggacccgcgagggcgagaagaagaagcuccggccccgcuggcuggacgcgcgggucuacgccgaccccauggcccugaaggacuucaaggaguucgccuccgggcgcaagagcaucacgcucgacauccugaccgagaucgccucccugccgaccuaccucagcagccgcgcgaagcuggcccuggacaacaucgugaugcuccacaccaccgagcggggcggccgcgccuaccagcacgcccugaacgagcugcccgagucccucgagacgcugaugcugguggcgcuccugggggccaugaccgccggcaucuuccuguucuucaugcaggggaagggcaucgggaagcucagcaugggccugaucaccaucgccgucgccuccggccugcucuggguggcggagauccagccccaguggaucgccgccagcaucauccuggaguucuuccugauggugcuccugaucccggagcccgagaagcagcggacgccccaggacaaccagcugaucuacgucauccucgccauccugacgaucaucgggcugaucgccgcgaacgagaugggccucaucgagaagaccaagaccgacuucggguucuaccaggugaagaccgagacgaccauccuggacguggaccugcgccccgccuccgccuggacccucuacgccgucgccaccacgauccugaccccgaugcugcggcacaccaucgagaacaccagcgcgaaccucucccuggccgccaucgccaaccaggccgcggugcugaugggccucgggaagggcuggccccugcaccgcauggaccugggcgugccccuccuggccauggggugcuacagccaggucaaccccacgacccugaccgccucccucgugaugcugcuggugcacuacgccaucaucggcccggggcuccaggcgaaggccacccgggaggcccagaagcgcacggccgccggcaucaugaagaaccccaccgucgacggcaucaccgugaucgaccuggagcccaucagcuacgaccccaaguucgagaagcagcugggccaggugaugcuccugguccugugcgcgggccagcuccugcugaugcggaccacgugggccuucugcgaggugcucacccuggccaccgggccgauccugacccucugggagggcaaccccgggcgcuucuggaacacgaccaucgccguguccaccgccaacaucuuccggggcagcuaccuggcgggcgccgggcuggccuucucccucaucaagaacgcccagacgccccggcggggcacggggaccaccggcgagacccugggggagaaguggaagcgccagcugaacagccucgaccggaaggaguucgaggaguacaagcgcuccggcauccuggaggucgaccggacggaggccaagagcgcgcugaaggacggcuccaagaucaagcacgccgugagccgcggguccagcaagauccgguggaucguggagcgcggcauggucaagcccaaggggaaggugguggaccucggcugcgggcgcggcggcuggagcuacuacauggccacccugaagaacgucaccgaggugaagggguacaccaagggcgggccgggccacgaggagcccauccccauggccaccuacggguggaaccuggugaagcuccacuccggcgucgacguguucuacaagcccacggagcaggucgacacccugcugugcgacaucggcgagagcuccagcaacccgaccaucgaggaggggcggacccuccgcguccugaagaugguggagcccuggcuguccagcaagcccgaguucugcaucaagguccugaaccccuacaugccgacggugaucgaggagcucgagaagcugcagcggaagcacggcgggaaccuggugcgcugcccccucucccggaacagcacccacgagauguacugggucuccggcgcgagcggcaacaucguguccagcgugaacaccaccuccaagaugcugcugaaccgcuucacgacccggcaccgcaagcccaccuacgagaaggacgucgaccucggggccggcacccggagcguguccacggagaccgagaagcccgacaugaccaucaucgggcgccggcugcagcgccugcaggaggagcacaaggagaccuggcacuacgaccaggagaacccguaccggacgugggccuaccacggcagcuacgaggcccccuccaccgggagcgccuccagcauggugaacggcgucgugaagcuccugaccaagcccugggacgugaucccgauggucacccagcuggcgaugacggacaccacccccuucggccagcagcgcguguucaaggagaagguggacacccggacgccccagcccaagccggggacccgcauggucaugaccaccacggccaacuggcucugggcccugcugggcaagaagaagaacccccggcucugcacccgcgaggaguucaucagcaaggugcgguccaacgccgccaucggggcgguguuccaggaggagcagggcuggaccagcgccuccgaggccgucaacgacagccgcuucugggagcugguggacaaggagcgggcccugcaccaggaggggaagugcgaguccugcguguacaacaugaugggcaagcgcgagaagaagcucggcgaguucgggcgcgccaagggcagccgggcgaucugguacauguggcugggggcccgcuuccuggaguucgaggcccucggcuuccugaacgaggaccacugguucgggcgggagaacuccuggagcggcgucgagggcgaggggcugcaccgccucggcuacauccuggaggagaucgacaagaaggacggggaccugauguacgccgacgacaccgcgggcugggacacgcggaucaccgaggacgaccuccagaacgaggagcugaucaccgagcagauggcgccccaccacaagauccuggccaaggccaucuucaagcucaccuaccagaacaagguggugaagguccugcgccccacgccgcggggcgccgugauggacaucaucucccgcaaggaccagcgggggagcggccagguggggaccuacggccugaacaccuucaccaacauggagguccagcucauccgccagauggaggcggagggggugaucacccaggacgacaugcagaaccccaagggccugaaggagcggguggagaaguggcugcgcgagugcggcgucgaccggcucaagcgcauggccaucuccggggacgacugcguggugaagccccuggacgagcgguucggcacgagccuccuguuccugaacgacauggggaagguccgcaaggacaucccccagugggagccguccaagggcuggaagaacuggcaggaggugcccuucugcagccaccacuuccacaagaucuucaugaaggacgggcggucccuggugguccccugccgcaaccaggacgagcucaucggccgggcccgcaucagccagggcgccggguggucccugcgcgagaccgccugccugggcaaggcguacgcccagauguggagccucauguacuuccaccggcgcgaccugcggcuggccagcauggccaucugcuccgccgugcccaccgagugguucccgaccagccgcacgaccugguccauccacgcgcaccaccaguggaugaccaccgaggacaugcucaagguguggaaccgggucuggaucgaggacaaccccaacaugaucgacaagacgcccgugcacagcugggaggacauccccuaccuggggaagcgcgaggaccuguggugcggcucccucaucgggcugagcucccgggccaccugggccaagaacauccacaccgccaucacccaggugcgcaaccugaucggcaaggaggaguacgucgacuacaugccggugaugaagcgguacagcgcccccuccgagagcgagggcgugcucuga

SEQ ID NO: 10526 - RNA, 9867 nt, Artificial Sequence
  derived and/or modified CDS sequence (opt1) from DENV-4__JQ513336__SS-prME
agcaccaucacccugcucugccugauccccaccgugauggccuuccaccuguccacccgcgacggcgagccccucaugaucguggccaagcacgagcgggggcgcccccugcuguucaagaccaccgagggcaucaacaagugcacgcucaucgccauggaccugggggagaugugcgaggacaccgugaccuacaagugcccccugcucgugaacaccgagcccgaggacaucgacugcuggugcaaccugacgagcaccugggugauguacgggaccugcacccaguccggggagcggcgccgggagaagcgcagcguggcccugacgccgcacuccggcaugggccucgagacccgggccgagaccuggaugagcuccgagggggccuggaagcacgcccagcgcguggagagcuggauccugcggaaccccggcuucgcgcugcucgccggguucauggccuacaugaucggccagaccgggauccagcgcacgguguucuucgugcugaugaugcugguggcccccuccuacggcaugcggugcgugggcguggggaaccgcgacuucguggagggcgucagcgggggcgcguggguggaccucgugcuggagcacggcgggugcgucaccaccauggcccagggcaagcccacccuggacuucgagcucacgaagaccaccgccaaggagguggcccugcugcggaccuacugcaucgaggccuccaucagcaacaucacgaccgcgacccgcugcccgacccagggggagcccuaccucaaggaggagcaggaccagcaguacaucugccggcgcgacguggucgaccggggcugggggaacggcugcggccuguucgggaagggcgggguggugacgugcgccaaguucuccugcagcgagaagaucaccggcaaccugguccagaucgagaaccucgaguacaccgugguggucaccgugcacaacggggacacgcacgccgucggcaacgacaccuccaaccacggcgugaccgccaccaucacgccccgcagccccuccguggaggucgagcugccggacuacggggagcugacccucgacugcgagccccggagcggcaucgacuucaacgagaugauccugaugaagaugaagaagaagaccuggcuggugcacaagcagugguuccucgaccugccccugcccugggccgcgggggccgacaccuccgaggugcacuggaacuacaaggagcgcauggucaccuucaaggugccgcacgccaagcggcaggacgugacgguccucggcagccaggagggggccaugcacagcgcccuggcgggcgccaccgagguggacuccggcgacgggaaccacauguucgccggccaccugaagugcaaggugcgcauggagaagcuccgcaucaaggggaugagcuacaccaugugcuccggcaaguucagcaucgacaaggagauggccgagacccagcacggcacgaccgucgugaaggugaaguacgagggggccggcgcgcccugcaagguccccaucgagauccgggacgugaacaaggagaagguggucgggcgcgugaucuccagcaucccccuggccgagaacaccaacuccgugaccaacaucgagcuggagccgcccuucggcgacagcuacaucgucaucggggugggcaacuccgcccucacgcugcacugguuccggaagggcagcuccaucgggaagauguucgagagcaccuaccgcggcgccaagcggauggcgauccugggggagaccgccugggacuucggcuccgucgggggccucuucaccagccuggggaaggccguccaccagguguucggguccguguacacgaccauguucggcggggucagcuggauggugcgcauccugaucggccuccuggugcuguggaucgggaccaacucccggaacaccagcauggccaugacgugcaucgccgucggcggcaucacccuguuccucggguucaccgugcaggcggacaugggcugcguggucuccuggagcgggcgcgagcugaagugcggcagcgggaucuucgugguggacaacguccacaccuggacggagcaguacaaguuccagcccgagucccccgcccggcuggccagcgccauccucaacgcccacaaggacggcgugugcggcauccgcuccaccacccggcuggagaacgugauguggaagcagaucaccaacgagcugaacuacguccucugggagggcggccacgaccugacggugguggcgggggacgucaagggcgugcugaccaagggcaagcgcgcccucaccccgcccgugagcgaccugaaguacuccuggaagaccugggggaaggccaagaucuucacgcccgaggcccggaacagcaccuuccugaucgacggccccgacaccuccgagugcccgaacgagcgccgggccuggaacagccucgaggucgaggacuacggguucggcauguucaccacgaacaucuggaugaaguuccgcgagggguccagcgaggugugcgaccaccggcugauguccgcggccaucaaggaccagaaggccgugcacgccgacaugggcuacuggaucgagagcuccaagaaccagaccuggcagaucgagaaggcgagccugaucgaggucaagaccugccucuggcccaagacccacacgcugugguccaacggcgugcuggagagccagaugcucauccccaaguccuacgccgggccguucagccagcacaacuaccgccagggcuacgccacccagaccguggggcccuggcaccugggcaagcuggagaucgacuucggggagugccccggcaccaccgucacgauccaggaggacugcgaccaccggggccccagccuccgcaccaccaccgccuccgggaagcuggugacgcaguggugcugccgcagcugcaccaugccgccccugcgguuccucggcgaggacgggugcugguacggcauggagauccgcccccuguccgagaaggaggagaacauggucaagagccagguggccgcggggcagggcaccuccgagaccuucagcaugggccugcucugccugacgcuguucguggaggagugccuccggcgccgggucacccgcaagcacaugauccuggccguggugaucacccugugcgccaucauccucgggggccugaccuggauggaccugcuccgggcccugaucaugcugggggacacgauguccggccgcaucggcgggcagacccaccucgccaucauggcggucuucaagaugagccccggcuacgugcuggggguguuccugcggaagcucaccucccgcgagaccgcccugauggucaucggcauggccaugacgaccacccugagcaucccgcacgaccucauggagcugaucgacgggaucucccugggccucauccugcugaagaucgugacccaguucgacaacacccaggugggcacccucgcccugagccugaccuucauccgguccaccaugagccucgucauggccuggcgcacgaucauggcggugcuguucguggucacccugaucccccucugccggaccuccugccugcagaagcagagccacuggguggagaucaccgcccugauccucggggcccaggcccugcccguguaccugaugacgcucaugaagggcgcgucccgccggagcuggccccugaacgaggggaucauggccgucggccuggugucccuccuggggagcgcccugcucaagaacgacgugccgcuggccggccccauggucgccggcgggcugcuccuggcggccuacgugaugagcggcuccagcgccgaccugucccucgagaaggccgccaacgugcagugggacgagauggcggacaucaccgggagcucccccaucaucgaggucaagcaggacgaggacggcagcuucuccauccgcgacguggaggagaccaacaugaucacccugcuggugaagcucgcccugaucacggucagcgggcuguacccccucgccaucccggugaccaugacccugugguacauguggcaggucaagacccagcgguccggcgcccugugggacguccccagccccgccgcgacgcagaaggccgcccucuccgagggcguguaccgcaucaugcagcgggggcuguucggcaagacccaggugggggucggcauccacauggaggggguguuccacaccauguggcacgugacccgcggcagcgucaucugccacgagaccggccggcuggagcccuccugggccgacgugcgcaacgacaugaucagcuacgggggcggguggcgccucggcgacaagugggacaaggaggaggacgugcagguccuggccaucgagccgggcaagaaccccaagcacgugcagacgaagcccgggcuguucaagacccucaccggcgagaucggggcggugacccuggacuucaagcccggcacguccgggagcccgaucaucaaccggaagggcaaggucaucggccuguacgggaacggcguggugaccaaguccggggacuacgucagcgccaucacccaggccgagcgcaucggcgagcccgacuacgagguggacgaggacaucuuccggaagaagcgccucaccaucauggaccugcaccccggggccggcaagacgaagcggauccugccguccaucgugcgcgaggcgcugaagcggcgccuccggacccugauccuggcccccacccgcgucguggccgccgagauggaggaggcccuccggggccugcccauccgcuaccagacccccgcggucaagagcgagcacacggggcgggagaucgucgaccugaugugccacgccaccuucaccacccgccuccugagcuccacgcgggugccgaacuacaaccugaucgucauggacgaggcccacuucaccgaccccagcuccguggccgcccgcggcuacaucagcacccggguggagaugggggaggcggccgccaucuucaugaccgccacgccgcccggcgccaccgacccguucccccaguccaacagccccaucgaggacaucgagcgcgagauccccgagcgguccuggaacaccggguucgacuggaucaccgacuaccagggcaagacggucugguucgugccgagcaucaaggcgggcaacgacaucgccaacugccuccgcaaguccgggaagaaggugauccagcugagccgcaagaccuucgacaccgaguaccccaagaccaagcugacggacugggacuucgucgugaccaccgacaucuccgagaugggcgccaacuuccgggccgggcgcgugaucgacccccggcgcugccucaagcccgucauccugaccgacggcccggagcgggugauccuggcggggcccauccccgugacgcccgccagcgccgcccagcgccggggccgcaucggccggaacccggcccaggaggacgaccaguacgucuucuccggggacccccucaagaacgacgaggaccacgcgcacuggaccgaggccaagaugcugcuggacaacaucuacacccccgagggcaucauccccacccucuucgggccggagcgcgagaagacgcaggccaucgacggcgaguuccggcugcgcggcgagcagcggaagaccuucguggagcugaugcgccgcggggaccuccccguguggcugagcuacaaggucgccuccgccggcaucagcuacaaggaccgcgaguggugcuucaccggggagcggaacaaccagauccuggaggagaacauggagguggagaucuggacccgcgagggcgagaagaagaagcuccggccccgcuggcuggacgcgcggguguacgccgaccccauggcccugaaggacuucaaggaguucgccuccgggcgcaagagcaucacgcucgacauccugaccgagaucgccucccugccgaccuaccucagcagccgcgcgaagcuggcccuggacaacaucgucaugcuccacaccaccgagcggggcggccgcgccuaccagcacgcccugaacgagcugcccgagucccucgagacgcugaugcugguggcgcuccugggggccaugaccgccggcaucuuccuguucuucaugcaggggaagggcaucgggaagcucagcaugggccugaucaccaucgccguggccuccggccugcucugggucgcggagauccagccccaguggaucgccgccagcaucauccuggaguucuuccugauggugcuccugaucccggagcccgagaagcagcggacgccccaggacaaccagcugaucuacgugauccucgccauccugacgaucaucgggcugaucgccgcgaacgagaugggccucaucgagaagaccaagaccgacuucggguucuaccaggucaagaccgagacgaccauccuggacguggaccugcgccccgccuccgccuggacccucuacgccguggccaccacgauccugaccccgaugcugcggcacaccaucgagaacaccagcgcgaaccucucccuggccgccaucgccaaccaggccgcgguccugaugggccucgggaagggcuggccccugcaccgcauggaccugggcgugccccuccuggccauggggugcuacagccaggugaaccccacgacccugaccgccucccucgucaugcugcuggugcacuacgccaucaucggcccggggcuccaggcgaaggccacccgggaggcccagaagcgcacggccgccggcaucaugaagaaccccaccguggacggcaucaccgucaucgaccuggagcccaucagcuacgaccccaaguucgagaagcagcugggccaggugaugcuccuggugcugugcgcgggccagcuccugcugaugcggaccacgugggccuucugcgagguccucacccuggccaccgggccgauccugacccucugggagggcaaccccgggcgcuucuggaacacgaccaucgccguguccaccgccaacaucuuccggggcagcuaccuggcgggcgccgggcuggccuucucccucaucaagaacgcccagacgccccggcggggcacggggaccaccggcgagacccugggggagaaguggaagcgccagcugaacagccucgaccggaaggaguucgaggaguacaagcgcuccggcauccuggagguggaccggacggaggccaagagcgcgcugaaggacggcuccaagaucaagcacgccgucagccgcggguccagcaagauccgguggaucguggagcgcggcauggugaagcccaaggggaaggucguggaccucggcugcgggcgcggcggcuggagcuacuacauggccacccugaagaacgugaccgaggucaagggguacaccaagggcgggccgggccacgaggagcccauccccauggccaccuacggguggaaccuggugaagcuccacuccggcguggacgucuucuacaagcccacggagcaggucgacacccugcugugcgacaucggcgagagcuccagcaacccgaccaucgaggaggggcggacccuccgcgugcugaagauggucgagcccuggcuguccagcaagcccgaguucugcaucaaggugcugaaccccuacaugccgacggucaucgaggagcucgagaagcugcagcggaagcacggcgggaaccuggugcgcugcccccucucccggaacagcacccacgagauguacuggguguccggcgcgagcggcaacaucgucuccagcgugaacaccaccuccaagaugcugcugaaccgcuucacgacccggcaccgcaagcccaccuacgagaaggacguggaccucggggccggcacccggagcgucuccacggagaccgagaagcccgacaugaccaucaucgggcgccggcugcagcgccugcaggaggagcacaaggagaccuggcacuacgaccaggagaacccguaccggacgugggccuaccacggcagcuacgaggcccccuccaccgggagcgccuccagcauggugaacggcguggucaagcuccugaccaagcccugggacgugaucccgauggugacccagcuggcgaugacggacaccacccccuucggccagcagcgcgucuucaaggagaagguggacacccggacgccccagcccaagccggggacccgcauggugaugaccaccacggccaacuggcucugggcccugcugggcaagaagaagaacccccggcucugcacccgcgaggaguucaucagcaagguccgguccaacgccgccaucggggcgguguuccaggaggagcagggcuggaccagcgccuccgaggccgugaacgacagccgcuucugggagcuggucgacaaggagcgggcccugcaccaggaggggaagugcgaguccugcguguacaacaugaugggcaagcgcgagaagaagcucggcgaguucgggcgcgccaagggcagccgggcgaucugguacauguggcugggggcccgcuuccuggaguucgaggcccucggcuuccugaacgaggaccacugguucgggcgggagaacuccuggagcggcguggagggcgaggggcugcaccgccucggcuacauccuggaggagaucgacaagaaggacggggaccugauguacgccgacgacaccgcgggcugggacacgcggaucaccgaggacgaccuccagaacgaggagcugaucaccgagcagauggcgccccaccacaagauccuggccaaggccaucuucaagcucaccuaccagaacaaggucgugaaggugcugcgccccacgccgcggggcgccgucauggacaucaucucccgcaaggaccagcgggggagcggccagguggggaccuacggccugaacaccuucaccaacauggaggugcagcucauccgccagauggaggcggagggggucaucacccaggacgacaugcagaaccccaagggccugaaggagcggguggagaaguggcugcgcgagugcggcguggaccggcucaagcgcauggccaucuccggggacgacugcgucgugaagccccuggacgagcgguucggcacgagccuccuguuccugaacgacauggggaaggugcgcaaggacaucccccagugggagccguccaagggcuggaagaacuggcaggagguccccuucugcagccaccacuuccacaagaucuucaugaaggacgggcggucccugguggugcccugccgcaaccaggacgagcucaucggccgggcccgcaucagccagggcgccggguggucccugcgcgagaccgccugccugggcaaggcguacgcccagauguggagccucauguacuuccaccggcgcgaccugcggcuggccagcauggccaucugcuccgccguccccaccgagugguucccgaccagccgcacgaccugguccauccacgcgcaccaccaguggaugaccaccgaggacaugcucaagguguggaaccggguguggaucgaggacaaccccaacaugaucgacaagacgcccguccacagcugggaggacauccccuaccuggggaagcgcgaggaccuguggugcggcucccucaucgggcugagcucccgggccaccugggccaagaacauccacaccgccaucacccaggugcgcaaccugaucggcaaggaggaguacguggacuacaugccggucaugaagcgguacagcgcccccuccgagagcgagggcgugcucuga

SEQ ID NO: 10527 - RNA, 9867 nt, Artificial Sequence
  derived and/or modified CDS sequence (opt1) from DENV-4__JQ513338__SS-prME
agcaccaucacccugcucugccugauccccacggugauggccuuccaccuguccacccgggacggcgagccccucaugaucguggccaagcacgagcgggggcggccccugcuguucaagaccaccgagggcaucaacaagugcacgcucaucgcgauggaccugggggagaugugcgaggacaccgugaccuacaagugcccccugcucgugaacaccgagcccgaggacaucgacugcuggugcaaccugacgagcaccugggugauguacgggaccugcacccaguccggggagcggcgccgggagaagcgcagcguggcccugacgccccacuccggcaugggccucgagacccgggccgagaccuggaugagcuccgagggggccuggaagcacgcccagcgcguggagagcuggauccugcggaaccccggcuucgcgcugcucgccggguucauggccuacaugaucggccagaccgggauccagcgcacggucuucuucgugcugaugaugcugguggcccccuccuacggcaugcggugcgucggcguggggaaccgcgacuucguggagggcgucagcgggggcgcguggguggaccucgugcuggagcacggcgggugcgucaccaccauggcccagggcaagcccacccuggacuucgagcucacgaagaccaccgccaaggagguggcccugcugcggaccuacugcaucgaggcccucaucuccaacaucacgaccgcgacccgcugcccgacccagggggagcccuaccugaaggaggagcaggagcagcaguacaucugccggcgcgacguggucgaccggggcugggggaacggcugcggccuguucgggaagggcgggguggugacgugcgccaaguucagcugcuccggcaagaucaccgggaaccucguccagaucgagaaccuggaguacaccgugguggucaccgugcacaacggcaacacgcccgccgucggcaacgacaccagcaaccacggggugaccgcccccaucacgccccgcucccccagcguggaggucaagcugcccgacuacggcgagcucacccuggacugcgagccccgguccgggaucgacuucaacgagaugauccugaugaagaugaagaagaagaccuggcucgugcacaagcagugguuccuggaccugccgcuccccuggaccaccggcgccgacaccagcgaggugcacuggaacuacaaggagcgcauggucacguucaaggugccccacgcgaagcggcaggacgugaccguccuggggucccaggagggcgccaugcacagcgcccuggccggcgccaccgagguggacagcggggacgagaaccacauguucgcgggccaccucaagugcaaggugcgcauggggaagcugcgcaucaagggcauguccuacaccaugugcagcggcaaguucuccaucgacaaggagauggccgagacgcagcacgggaccaccgucgugaaggugaaguacgagggcgccggggcccccugcaaggucccgaucgagauccgggacgugaacaaggagaagguggucggccgcgugaucagcgccacgccccuggcggagaacacgaacuccgugaccaacaucgagcucgagccgcccuucggggaccgguacaucgucaucggcgugggcaacagcgcccugacccugcacugguuccgcaagggguccagcaucggcaagauguucgaguccaccuaccgcggggccaagcgcauggccauccucggcgagacggcgugggacuucgggagcgugggcggccuguucaccucccuggggaaggccguccaccagguguucggcagcguguacaccaccauguucgggggcgucuccuggaugauccggauccucaucggguuccuggugcuguggaucggcacgaacagccgcaacaccuccauggccaugaccugcaucgccgugggcgggaucacccuguuccucggcuucacgguccaggccgacauggggugcguggugagcugguccggccgggagcugaagugcgggagcggcaucuucgucguggacaacgugcacaccuggaccgagcaguacaaguuccagccggagucccccgcgcgccuggccagcgccauccucaacgcccacaaggacggcgucugcgggauccggagcaccacgcgccuggagaacgugauguggaagcagaucaccaacgagcugaacuacgugcucugggagggcgggcacgaccugaccgucguggccggcgacgugaagggcguccugaccaaggggaagcgggcgcucacgccgcccgccuccgaccugaaguacagcuggaagaccuggggcaaggccaagaucuucaccccggaggcccgcaacuccaccuuccugaucgacgggcccgacacgagcgagugccccaacgagcggcgcgccuggaacuccuucgagguggaggacuacggcuucgggauguucaccaccaacaucuggaugaaguuccgggagggcagcuccgaggugugcgaccaccgccucaugagcgcggccaucaaggaccagaaggccguccacgccgacaugggcuacuggaucgaguccagcaagaaccagaccuggcagaucgagcgggcgucccugaucgaggugaagacgugccuguggccgaagacccacacccucuggagcaacggggugcuggagucccagaugcugauccccaagagcuacgccggccccuucucccagcacaacuaccgccagggguacgccacccagaccgucggccccuggcaccucgggaagcuggagaucgacuucggcgagugcccgggcacgaccgugaccauccaggagaacugcgaccaccgcgggcccagccugcggaccacgaccgccuccggcaagcucgugacccaguggugcugccgcagcugcaccaugccgccccugcgguuccugggggaggacggcugcugguacgggauggagauccgcccgcucagcgagaaggaggagaacauggucaagucccaggugacggccggccagggcaccagcgagaccuucuccauggggcugcugugccucacccuguucgucgaggagugccugcggcgccgggugacgcgcaagcacaugauccucgcgguggucaucacccugugcgccaucauccugggcgggcucaccuggauggaccugcugcgggcccucaucaugcugggcgacaccaugagcggccgcaucgggggccagacgcaccuggccaucauggccguguucaagaugucccccggguacgugcucggcgucuuccugcggaagcugaccagccgcgagaccgcgcucauggugaucgggauggccaugaccacgacccuguccaucccccacgaccugauggagcucaucgacggcaucagccugggccugauccuccugaagaucgugacccaguucgacaacacccaggucgggacgcuggcccucucccugaccuucauccggagcaccaugucccuggugauggccuggcgcaccaucauggccguccucuucgucgugacgcugaucccccugugccggaccagcugccuccagaagcagucccacuggguggagaucaccgcgcugauccugggcgcccaggcccucccggucuaccugaugacccugaugaagggggccagccgccgguccuggccccucaacgagggcaucauggcgguggggcuggugagccugcucggcuccgcccugcugaagaacgacgucccccucgccggccccaugguggccgggggccugcugcucgccgcguacgugaugagcggguccagcgccgaccugagccuggagaaggccgccaacguccagugggacgagauggccgacaucacgggcuccagcccgaucaucgaggugaagcaggacgaggacggguccuucagcauccgcgacguggaggagaccaacaugaucacccuccuggucaagcuggcgcucaucaccguguccggccuguacccccuggccauccccaucacgaugacccucugguacauguggcaggucaagacccagcggagcggcgcccugugggacguccccuccccggccgccacccagaaggcggcccugagcgaggggguguaccgcaucaugcagcggggccucuucgggaagacccaggugggcgucgggauccacauggagggcguguuccacacgauguggcacgugacccgcggcuccgucaucugccacgagaccgggcgccuggagcccagcugggccgacgugcggaacgacaugaucuccuacggcgggggcuggcgccugggcgacaagugggacaaggaggaggacgugcagguccucgccaucgagcccgggaagaaccccaagcacgugcagaccaagccgggccuguucaagacgcugaccggggagaucggcgccgugacccucgacuucaagcccgggaccagcggcucccccaucaucaaccggaagggcaaggucaucgggcuguacggcaacgggguggugaccaagagcggcgacuacgucuccgcgaucacccaggccgagcgcaucggggagccggacuacgagguggacgaggacaucuuccggaagaagcgccugaccaucauggaccuccaccccggcgccggcaagaccaagcggauccugcccagcaucgugcgcgaggcccugaagcggcgccugcggacgcucauccuggcgcccacccgcgucguggccgccgagauggaggaggcccugcgggggcucccgauccgcuaccagacccccgccgugaaguccgagcacaccggccgggagaucgucgaccugaugugccacgcgacguucaccacccgccugcucagcuccacccgggugcccaacuacaaccugaucgugauggacgaggcccacuucacggaccccagcagcgucgccgcccgcggguacaucuccacccggguggagaugggcgaggccgcggccaucuucaugaccgccaccccgcccggggccacggaccccuucccccagagcaacuccccgaucgaggacaucgagcgcgagauccccgagcgcagcuggaacaccggcuucgacuggaucaccgacuaccagggcaagaccgucugguucgugcccuccaucaaggccgggaacgacaucgcgaacugccugcgcaagagcggcaagaaggugauccagcucucccgcaagacguucgacaccgaguaccccaagaccaagcugaccgacugggacuucgucgugacgaccgacaucagcgagaugggggccaacuuccgggccggccgcgugaucgacccgcggcgcugccugaagcccgucauccucaccgacgggcccgagcgggugauccuggccggccccaucccggugacccccgcguccgccgcccagcgccggggccgcaucgggcggaaccccgcccaggaggacgaccaguacgucuucagcggcgacccccugaagaacgacgaggaccacgcccacuggacggaggcgaagaugcuccuggacaacaucuacaccccggaggggaucauccccacccuguucggccccgagcgcgagaagacccaggccaucgacggcgaguuccggcuccgcggggagcagcggaagacguucguggagcugaugcgccggggcgaccugcccguguggcucuccuacaaggucgccagcgccgggaucuccuacaaggaccgcgaguggugcuucaccggcgagcggaacaaccagauccuggaggagaacauggagguggagaucuggacccgcgagggggagaagaagaagcugcggccgaaguggcucgacgcccgcguguacgcggaccccauggcccugaaggacuucaaggaguucgccagcggccgcaaguccaucacccuggacauccucaccgagaucgccagccugcccacguaccuguccagccgggccaagcucgcgcuggacaacaucgucaugcugcacaccaccgagcgcggcgggcgggccuaccagcacgcccucaacgagcugccggagucccuggagacccucaugcugguggcccugcucggcgcgaugacggccgggaucuuccuguucuucaugcagggcaaggggaucggcaagcugagcaugggccucaucaccaucgccguggccagcgggcugcugugggucgccgagauccagccccaguggaucgcggccuccaucauccucgaguucuuccugauggugcugcucauccccgagcccgagaagcagcgcaccccgcaggacaaccagcugaucuacgugauccugaccauccucacgaucaucggccugaucgccgccaacgagauggggcugaucgagaagaccaagaccgacuucggcuucuaccaggucaagaccgagacgaccauccucgacguggaccugcggcccgccagcgcguggacccuguacgccguggccaccacgauccucacccccaugcugcgccacaccaucgagaacaccuccgccaaccugagccucgccgcgaucgccaaccaggccgccguccugauggggcugggcaagggcuggccccuccaccggauggaccugggggugccgcugcucgccaugggcugcuacucccaggugaaccccacgacccugaccgcgagccuggucaugcuccuggugcacuacgccaucaucgggcccggccugcaggccaaggccacccgcgaggcgcagaagcggacggccgccggcaucaugaagaaccccaccguggacgggaucaccgucaucgaccucgagccgaucuccuacgaccccaaguucgagaagcagcugggccaggugaugcugcucgugcugugcgccgggcagcugcuccugaugcgcaccacgugggccuucugcgagguccugacccucgcgaccggccccauccugacccugugggaggggaaccccggccgguucuggaacacgaccaucgccgugagcaccgccaacaucuuccgcggcuccuaccucgccggggccggccuggcguucagccugaucaagaacgcccagaccccgcggcgcgggacgggcaccaccggggagacccucggcgagaaguggaagcggcagcugaacucccuggaccgcaaggaguucgaggaguacaagcggagcggcauccucgagguggaccgcaccgaggccaaguccgcccugaaggacgggagcaagaucaagcacgccgucucccggggcagcuccaagauccgcuggaucguggagcgcgggauggugaagcccaagggcaaggucaucgaccuggggugcggccggggcggguggagcuacuacauggcgacgcucaagaacgugaccgaggugaagggcuacaccaagggcggccccgggcacgaggagcccaucccgauggccaccuacggcuggaaccuggucaagcugcacuccggcguggacguguucuacaagcccacggagcaggucgacacccuccugugcgacaucggggagagcagcuccaaccccaccaucgaggagggccgcacccugcgggugcucaagaugguggagcccuggcugagcuccaagccggaguucugcaucaagguccugaaccccuacaugcccacggugaucgaggagcuggagaagcuccagcgcaagcacgggggcaaccuggugcggugcccccugagccgcaacuccacccacgagauguacugggucagcggcgccuccgggaacaucgugagcuccgucaacaccaccagcaagaugcuccugaaccgguucacgacccgccaccggaagccgaccuacgagaaggacguggaccugggcgccgggacccgcuccgugagcacggagaccgagaagcccgacaugaccaucaucggccggcgccuccagcggcugcaggaggagcacaaggagaccuggcacuacgaccaggagaaccccuaccgcacgugggcguaccacggguccuacgaggccccgagcaccggcuccgccagcuccauggucaacggcguggugaagcugcucaccaagcccugggacgucauccccauggugacccagcuggccaugacggacaccacccccuucgggcagcagcggguguucaaggagaaggucgacacccgcacgccgcagcccaagcccggcacccggauggugaugaccaccacggccaacuggcugugggcgcuccuggggaagaagaagaacccccgccugugcacccgggaggaguucaucagcaaggugcgcuccaacgccgccaucggcgccgucuuccaggaggagcagggguggaccagcgccagcgaggcggugaacgacucccgguucugggagcucguggacaaggagcgcgcccugcaccaggagggcaagugcgagagcugcgucuacaacaugaugggcaagcgcgagaagaagcugggggaguucggccgggccaaggggucccgcgccaucugguacauguggcucggcgcccgguuccuggaguucgaggcgcugggguuccucaacgaggaccacugguucggccgcgagaacagcugguccggcguggagggggagggccugcaccggcugggguacauccucgaggagaucgacaagaaggacggcgaccugauguacgccgacgacaccgccggcugggacacgcgcaucaccgaggacgaccugcagaacgaggagcucaucaccgagcagauggccccgcaccacaagauccuggcgaaggccaucuucaagcugaccuaccagaacaagguggucaaggugcuccggcccacgccccgcggggccgugauggacaucaucagccggaaggaccagcgcggcuccgggcaggucggcaccuacgggcugaacaccuucaccaacauggaggugcagcugauccggcagauggaggccgagggcgugaucacccaggacgacaugcagaaccccaagggccucaaggagcgcgucgagaaguggcugcgggagugcgggguggaccgccugaagcggauggccaucagcggcgacgacugcguggucaagccgcucgacgagcgcuucgggacgucccugcuguuccucaacgacaugggcaaggugcggaaggacaucccccagugggagcccagcaagggguggaagaacuggcaggaggugcccuucugcucccaccacuuccacaagaucuucaugaaggacggccgcagccuggucgugccgugccggaaccaggacgagcugaucggccgcgcgcgcaucucccagggggccggcuggagccuccgggagaccgccugccuggggaaggccuacgcccagauguggucccugauguacuuccaccgccgggaccuccgccuggcgagcauggccaucugcuccgccgugcccaccgagugguuccccaccagccggacgaccuggagcauccacgcccaccaccaguggaugaccaccgaggacaugcugaaggucuggaaccgcguguggaucgaggacaaccccaacaugaucgacaagacgccggugcacuccugggaggacauccccuaccucggcaagcgggaggaccuguggugcgggagccugaucggccucuccagccgcgccaccugggcgaagaacauccacaccgccaucacccagguccggaaccugaucggcaaggaggaguacguggacuacaugcccgugaugaagcgcuacuccgcccccagcgaguccgaggggguccuguga

SEQ ID NO: 10528 - RNA, 9867 nt, Artificial Sequence
  derived and/or modified CDS sequence (opt1) from DENV-4__JQ513339__SS-prME
agcaccaucacccugcucugccugauccccacggugauggccuuccaccuguccacccgcgacggcgagccgcucaugaucgucgccaagcacgagcgggggcgcccccugcuguucaagaccaccgagggcaucaacaagugcacgcucaucgcgauggaccugggggagaugugcgaggacaccgugaccuacaagugcccccugcucgugaacaccgagcccgaggacaucgacugcuggugcaaccugacgagcaccugggucauguacggcaccugcacccaguccggggagcggcgccgggagaagcgcagcguggcccugacgccgcacuccggcaugggccucgagacccgggccgagaccuggaugagcuccgagggggccuggaagcacgcccagcgcguggagagcuggauccugcggaaccccggcuucgcgcugcucgccggguucauggccuacaugaucggccagaccgggauccagcgcacggucuucuucgugcugaugaugcugguggcccccuccuacggcaugcggugcgucggcguggggaaccgcgacuucguggagggcgucagcgggggcgcguggguggaccucgugcuggagcacggcgggugcgucaccaccauggcccagggcaagcccacccuggacuucgagcucacgaagaccaccgccaaggagguggcccugcugcggaccuacugcaucgaggcccucaucuccaacaucacgaccgcgacccgcugcccgacccagggggagcccuaccugaaggaggagcaggaccagcaguacaucugccggcgcgacguggucgaccggggcugggggaacggcugcggccuguucgggaagggcgggguggugacgugcgccaaguucagcugcuccggcaagaucaccgggaaccucguccagaucgagaaccuggaguacaccgugguggucaccgugcacaacggcgacacgcacgccgucggcaacgacaccagcaaccacggggugaccgccaccaucacgccccgcucccccagcguggaggucaagcugccggacuacggcgagcucacccuggacugcgagccccgguccgggaucgacuucaacgagaugauccugaugaagaugaagaagaagaccuggcucgugcacaagcagugguuccuggaccugccccuccccuggaccaccggcgccgacacgagcgaggugcacuggaacuacaaggagcgcauggcgaccuucaaggucccgcacgccaagcggcaggacgugacccugcuggggucccaggagggcgccaugcacagcgcccucgccggcgcgaccgagguggacagcggggacgagaaccacauguucgccggccaccugaagugcaagguccgcauggggaagcugcgcaucaagggcauguccuacacgaugugcagcggcaaguucuccaucgacaaggagauggccgagacccagcacgggaccaccguggugaaggucaaguacgagggcgccggggcccccugcaaggugcccaucgagauccgggacgugaacaaggagaaggucgugggccgcgugcucagcgcgacgccccuggccgagaacaccaacuccgucaccaacaucgagcuggagccgcccuucggggacagcuacaucgugaucggcgugggcaacuccgcccucacccugcacugguucacgaaggggagcuccaucggcaagauguucgagagcaccuaccggggggccaagcgcauggcgauccugggcgagaccgccugggacuucggguccgucggcggccucuucaccagccuggggaaggccgugcaccagguguucggcuccgucuacacgaccauguucgggggcgugagcuggaugauccggauccugaucggguuccuggugcucuggaucggcaccaacucccgcaacaccagcauggccaugacgugcaucgccgucggcgggaucacccuguuccugggcuucaccgugcaggcggacauggggugcguggucuccuggagcggccgggagcucaagugcggguccggcaucuucgugguggacaacguccacaccuggacggagcaguacaaguuccagcccgagagccccgcccgccuggccagcgccauccugaacgcccacaaggacggcgugugcgggauccgguccaccacccgccucgagaacgugauguggaagcagaucaccaacgagcugaacuacguccugugggagggcgggcacgaccucacggugguggcgggcgacgucaagggcgugcugaccaaggggaagcgggcccugaccccgcccgccagcgaccucaaguacuccuggaagaccuggggcaaggccaagaucuucacgcccgaggcccgcaacagcaccuuccugaucgacgggcccgacaccuccgagugcccgaacgagcggcgcgcguggaacagcuucgagguggaggacuacggcuucgggauguucaccacgaacaucuggaugaaguuccgggagggcuccagcgaggucugcgaccaccgccugauguccgccgccaucaaggaccagaaggccgugcacgcggacaugggcuacuggaucgagagcuccaagaaccagaccuggcagaucgagcgggccagccucaucgaggugaagaccugccuguggcccaagacccacacccugugguccaacgggguccucgagagccagaugcugauccccaaguccuacgccggcccguucagccagcacaacuaccgccagggguacgccacgcagaccgugggccccuggcaccuggggaagcucgagaucgacuucggcgagugccccggcaccaccgugacgauccaggagaacugcgaccaccgggggcccucccugcgcaccaccaccgccagcggcaagcuggucacgcaguggugcugccgcagcugcaccaugccgccccuccgguuccugggggaggacggcugcugguacgggauggagauccgcccccuguccgagaaggaggagaacauggugaagagccaggugaccgcgggccagggcaccuccgagacguucagcauggggcuccugugccugacccucuucgucgaggagugccugcggcgccgggugacccgcaagcacaugauccuggccgucgugaucacccucugcgccaucauccugggcgggcugacguggauggaccuccugcgggcccugaucaugcucggcgacaccauguccggccgcaucgggggccagacccaccuggccaucauggcgguguucaagaugagccccggguacguccugggcguguuccuccggaagcugaccucccgcgagacggcccugauggugaucgggauggccaugaccaccacccucagcaucccgcacgaccugauggagcugaucgacggcaucucccucggccugauccugcucaagaucgucacgcaguucgacaacacccagguggggacccuggcccugagccucaccuucauccgguccacgaugagccuggugauggccuggcgcaccaucauggcgguccuguucguggugacccucaucccccugugccggaccuccugccugcagaagcagagccacugggucgagaucacggcccucauccugggcgcccaggcccugcccguguaccucaugacccugaugaagggggcgucccgccggagcuggccccugaacgagggcaucauggccguggggcucgucucccugcugggcagcgcccuccugaagaacgacgugccgcuggccggccccaugguggccgggggccuccugcuggcggccuacgucauguccgggagcagcgccgaccucucccuggagaaggccgccaacgugcagugggacgagauggcggacaucaccggcagcucccccaucaucgaggugaagcaggacgaggacgggagcuucuccauccgcgacgucgaggagaccaacaugaucacgcugcucgugaagcuggcccugaucaccgugagcggccucuacccccuggccaucccgaucaccaugacccugugguacauguggcaggucaagacccagcgguccggcgcccucugggacgugcccagccccgccgcgacgcagaaggccgcccuguccgaggggguguaccgcaucaugcagcggggccuguucgggaagacccaggucggcguggggauccacauggagggcguguuccacaccauguggcacgucacccgcggcagcgugaucugccacgagacggggcggcucgagcccuccugggccgacgugcgcaacgacaugaucagcuacggcgggggcuggcgccugggcgacaagugggacaaggaggaggacguccaggugcuggccaucgagccggggaagaaccccaagcacgugcagaccaagcccggccucuucaagacccugaccggggagaucggcgcggucacgcuggacuucaagcccgggaccuccggcagcccgaucaucaaccggaagggcaaggugaucgggcucuacggcaacgggguggucaccaaguccggcgacuacgugagcgccaucacccaggccgagcgcaucggggagcccgacuacgagguggacgaggacaucuuccggaagaagcgccugacgaucauggaccugcaccccggcgccggcaagaccaagcggauccugccguccaucguccgcgaggcgcucaagcggcgccugcggacccugauccucgcccccacccgcgugguggccgccgagauggaggaggcccugcgggggcugcccauccgcuaccagacgcccgcggucaagagcgagcacaccggccgggagaucguggaccucaugugccacgccaccuucaccacgcgccugcuguccagcacccgggugccgaacuacaaccucaucgucauggacgaggcccacuucaccgaccccagcuccguggccgcccgcggguacaucagcacccggguggagaugggcgaggcggccgccaucuucaugacggccaccccccccggggccaccgacccguucccccaguccaacagccccaucgaggacaucgagcgcgagauccccgagcgguccuggaacaccggcuucgacuggaucacggacuaccagggcaagaccgucugguucgugccgagcaucaaggcggggaacgacaucgccaacugccugcgcaaguccggcaagaaggucauccagcugagccgcaagaccuucgacaccgaguaccccaagacgaagcucaccgacugggacuucguggugaccaccgacaucuccgagaugggggccaacuuccgggccggccgcgucaucgacccccggcgcugccugaagcccgugauccugacggacgggccggagcgggugauccucgcgggccccauccccgucacccccgccagcgccgcccagcgccggggccgcaucgggcggaacccggcccaggaggacgaccaguacguguucuccggcgacccccugaagaacgacgaggaccacgcgcacuggaccgaggccaagaugcugcucgacaacaucuacacccccgaggggaucauccccacgcuguucggcccggagcgcgagaagacccaggccaucgacggcgaguuccggcugcgcggggagcagcggaagaccuucguggagcucaugcgccggggcgaccugcccgucuggcugagcuacaagguggccuccgccgggaucagcuacaaggaccgcgaguggugcuucaccggcgagcggaacaaccagauccucgaggagaacauggagguggagaucuggacccgcgagggggagaagaagaagcugcggcccaaguggcuggacgcgcgcgucuacgccgaccccauggcccucaaggacuucaaggaguucgccuccggccggaagagcaucacgcuggacauccugaccgagaucgccucccucccgaccuaccugagcucccgcgcgaagcuggcccucgacaacaucgugaugcugcacaccacggagcgcggcgggcgggccuaccagcacgcccugaacgagcuccccgagagccuggagacccugaugcucguggcgcugcugggcgccaugaccgccgggaucuuccucuucuucaugcagggcaaggggaucggcaagcugagcaugggccugaucaccaucgccgucgccuccgggcuccuguggguggcggagauccagccccaguggaucgccgccagcaucauccuggaguucuuccucauggugcugcugaucccggagcccgagaagcagcgcacgccccaggacaaccagcucaucuacgucauccugaccauccugaccaucaucggccucaucgccgccaacgagauggggcugaucgagaagaccaagacggacuucggcuucuaccaggugaagaccgagaccaccauccuggacguggaccuccggcccgcguccgccuggacgcuguacgccgucgccaccaccauccugaccccgaugcuccgccacacgaucgagaacaccagcgccaaccugucccuggcggccaucgccaaccaggccgccgugcucauggggcugggcaagggcuggccccugcaccggauggaccucggggugccccugcuggcgaugggcugcuacagccaggucaaccccaccacccucacggccucccuggugaugcugcucgugcacuacgccaucaucgggccgggccugcaggccaaggcgacccgcgaggcccagaagcggaccgccgccggcaucaugaagaaccccaccgucgacgggaucacggugaucgaccuggagcccaucagcuacgaccccaaguucgagaagcagcucggccaggugaugcugcugguccucugcgccgggcagcugcugcucaugcgcaccaccugggcguucugcgaggugcugacccuggccacgggcccgauccucacccugugggaggggaaccccggccgguucuggaacaccaccaucgccguguccacggccaacaucuuccgcggcagcuaccuggccggggcgggccucgccuucucccugaucaagaacgcccagaccccccggcgcgggaccggcaccaccggggagacgcugggcgagaaguggaagcggcagcucaacagccuggaccgcaaggaguucgaggaguacaagcgguccggcauccuggaggucgaccgcaccgaggccaagagcgcccucaaggacggguccaagaucaagcacgcggugagccggggcuccagcaagauccgcuggaucguggagcgggggauggucaagcccaagggcaaggugaucgaccuggggugcggccgcggcgggugguccuacuacauggccacccugaagaacgugaccgaggucaagggcuacacgaaggggggcccggggcacgaggagcccauccccauggccaccuacggcuggaaccucgugaagcugcacagcggcguggacgucuucuacaagcccaccgagcagguggacacccugcucugcgacaucggggagagcuccagcaacccgacgaucgaggagggccgcacccugcgggugcugaagauggucgagcccuggcuguccagcaagcccgaguucugcaucaaggugcucaaccccuacaugccgaccgugaucgaggagcuggagaagcugcagcgcaagcacgggggcaaccucguccggugcccccugucccgcaacagcacccacgagauguacuggguguccggcgccagcgggaacaucguguccagcgucaacacgaccuccaagaugcugcucaaccgguucaccacccgccaccggaagcccacguacgagaaggacguggaccugggcgcggggacccgcagcgucuccaccgagaccgagaagcccgacaugacgaucaucggccggcgccugcagcggcuccaggaggagcacaaggagaccuggcacuacgaccaggagaacccguaccgcaccugggccuaccacgggagcuacgaggcccccuccaccggcagcgccuccagcauggugaacggcguggucaagcugcugacgaagcccugggacgugaucccgauggugacccagcucgccaugaccgacaccacgcccuucgggcagcagcgggucuucaaggagaagguggacacccgcaccccccagcccaagccgggcacccggauggugaugacgaccaccgcgaacuggcugugggcccugcucgggaagaagaagaacccccgccugugcacccgggaggaguucaucuccaagguccgcagcaacgccgccaucggcgccguguuccaggaggagcagggguggacgagcgcguccgaggccgugaacgacagccgguucugggagcuggucgacaaggagcgcgcccuccaccaggagggcaagugcgaguccugcguguacaacaugaugggcaagcgggagaagaagcugggggaguucggccgcgccaaggggagccgcgccaucugguacauguggcugggcgcgcgguuccucgaguucgaggcccugggguuccugaacgaggaccacugguucggccgcgagaacuccuggagcggcguggagggggagggccuccaccggcugggguacauccuggaggagaucgacaagaaggacggcgaccucauguacgccgacgacaccgccggcugggacacccgcaucaccgaggacgaccugcagaacgaggagcugaucaccgagcagauggcgccccaccacaagauccucgccaaggccaucuucaagcugacguaccagaacaaggucgugaaggugcugcggcccaccccgcgcggggccgucauggacaucaucucccggaaggaccagcgcggcagcgggcaggugggcaccuacgggcucaacaccuucacgaacauggaggugcagcugauccggcagauggaggccgagggcgucaucacccaggacgacaugcagaaccccaagggccugaaggagcgcguggagaaguggcuccgggagugcgggguggaccgccugaagcggauggcgaucuccggcgacgacugcgucgugaagccccuggacgagcgcuucgggaccagccuccuguuccugaacgacaugggcaaggugcggaaggacaucccccagugggagccguccaagggguggaagaacuggcaggagguccccuucugcagccaccacuuccacaagaucuucaugaaggacggccgcucccucguggugcccugccggaaccaggacgagcugaucggccgcgcccggaucagccagggggccggcuggucccugcgcgagaccgccugccucgggaaggccuacgcgcagauguggagccugauguacuuccaccgccgggaccugcgccucgccuccauggccaucugcagcgccguccccacggagugguucccgaccagccggaccaccugguccauccacgcccaccaccaguggaugacgaccgaggacaugcugaagguguggaaccgcguguggaucgaggacaaccccaacaugaucgacaagacccccguccacagcugggaggacauccccuaccugggcaagcgggaggaccucuggugcgggucccugaucggccugagcucccgcgcgaccugggccaagaacauccacacggccaucacccaggugcggaaccucaucggcaaggaggaguacguggacuacaugccggucaugaagcgcuacagcgcccccuccgagagcgagggggugcuguga

SEQ ID NO: 10529 - RNA, 9867 nt, Artificial Sequence
  derived and/or modified CDS sequence (opt1) from DENV-4__JQ513343__SS-prME
agcaccaucacccugcucugccugauccccacggugauggccuuccaccuguccacccgcgacggcgagccccucaugaucguggccaagcacgagcgggggcgcccccugcuguucaagaccaccgagggcaucaacaagugcacgcucaucgccauggaccugggggagaugugcgaggacaccgugaccuacaagugcccccugcucgugaacaccgagcccgaggacaucgacugcuggugcaaccugacgagcaccugggugauguacgggacgugcacccaguccggggagcggcgccgggagaagcgcagcguggcccugacgccgcacuccggcaugggccucgagacccgggccgagaccuggaugagcuccgagggggccuggaagcacgcccagcgcguggagagcuggauccugcggaaccccggcuucgcgcugcucgccggguucauggccuacaugaucggccagaccgggauccagcgcacggucuucuucgugcugaugaugcugguggcccccuccuacggcaugcggugcgucggcguggggaaccgcgacuucguggagggcgucagcgggggcgcguggguggaccucgugcuggagcacggcgggugcgucaccaccauggcccagggcaagcccacccuggacuucgagcucacgaagaccaccgccaaggagguggcccugcugcggaccuacugcaucgaggcccucaucuccaacaucacgaccgcgacccgcugcccgacccagggggagcccuaccugaaggaggagcaggaccagcaguacaucugccggcgcgacguggucgaccggggcugggggaacggcugcggccuguucgggaagggcgggguggugacgugcgccaaguucagcugcuccggcaagaucaccgggaaccucguccagaucgagaaccuggaguacaccgugguggucaccgugcacaacggcgacacgcacgccgucggcaacgacaccagcaaccacggggugaccgccaccaucacgccccgcucccccagcguggaggucaagcugccggacuacggcgagcucacccuggacugcgagccccgguccgggaucgacuucaacgagaugauccugaugaagaugaagaagaagaccuggcucgugcacaagcagugguuccuggaccugccccuccccuggaccaccggcgccgacacgagcgaggugcacuggaacuacaaggagcgcauggagaccuucaaggucccgcacgcgaagcggcaggacgugacccugcuggggucccaggagggcgccaugcacagcgcccucgccggcgccaccgagguggacagcggggacgagaaccacauguucgcgggccaccugaagugcaagguccgcauggagaagcugcgcaucaaggggauguccuacacgaugugcagcggcaaguucuccaucgacaaggagauggccgagacccagcacggcaccaccguggugaaggucaaguacgagggggccggcgcccccugcaaggugcccaucgagauccgggacgugaacaaggagaaggucguggggcgcgugaucagcgccacgccccucgcggagaacaccaacuccgucaccaacaucgagcuggagccgcccuucggcgacagcuacaucgugaucggggugggcaacuccgcccugacccuccacugguuccggaagggcagcuccaucgggaagauguucgagagcacguaccgcggcgccaagcggauggccauccugggggagaccgcgugggacuucggcuccgucgggggccuguucaccagccucggcaaggccgugcaccagguguucggguccgucuacaccacgauguucggcggggugagcuggaugauccgcauccugaucggcuuccuggugcuguggaucgggaccaacucccggaacaccagcauggccaugaccugcaucgccgucggcggcaucacccucuuccugggguucaccgugcaggccgacaugggcugcguggucuccuggagcgggcgcgagcugaagugcggcuccgggaucuucgugguggacaacguccacaccuggaccgagcaguacaaguuccagcccgagagccccgcgcggcucgccagcgccauccugaacgcccacaaggacggcgugugcggcauccgcuccacgacccggcuggagaacgugauguggaagcagaucaccaacgagcucaacuacguccugugggagggcgggcacgaccugaccgugguggccggggacgucaagggcgugcucacgaagggcaagcgcgcgcugaccccgcccgccagcgaccugaaguacuccuggaagaccugggggaaggccaagaucuucacccccgaggcccggaacagcacguuccucaucgacggccccgacaccuccgagugcccgaacgagcgccgggccuggaacagcuucgagguggaggacuacggguucggcauguucaccaccaacaucuggaugaaguuccgcgagggguccagcgaggucugcgaccaccggcugauguccgcggccaucaaggaccagaaggccgugcacgccgacaugggcuacuggaucgagagcuccaagaaccagacguggcagaucgagcgcgcgagccugaucgaggugaagaccugccucuggcccaagacccacacccugugguccaacggcguccuggagagccagaugcucauccccaaguccuacgccgggccguucagccagcacaacuaccggcagggcuacgccacccagacgguggggcccuggcaccugggcaagcuggagaucgacuucggggagugccccggcaccaccgugaccauccaggagaacugcgaccaccgcggccccucccuccgcacgaccaccgccagcgggaagcuggucacccaguggugcugccggagcugcacgaugccgccccugcgcuuccucggcgaggacgggugcugguacggcauggagauccggccccuguccgagaaggaggagaacauggucaagagccaggugaccgccgggcagggcaccuccgagaccuucagcaugggccugcucugccugacgcuguucgucgaggagugccuccgccggcgcgugacccggaagcacaugauccuggcggucgugaucacccugugcgccaucauccucgggggccugaccuggauggaccugcuccgcgcccugaucaugcugggggacacgauguccggccggaucggcgggcagacccaccucgccaucauggccguguucaagaugagccccggcuacguccuggggguguuccugcgcaagcucaccucccgggagaccgcgcugauggugaucggcauggccaugacgaccacccugagcaucccgcacgaccucauggagcugaucgacgggaucucccugggccucauccugcugaagaucgucacccaguucgacaacacccaggugggcacccucgcccugagccugaccuucauccgcuccaccaugagccucgugauggccuggcggacgaucauggccguccuguucguggugacccugaucccccucugccgcaccuccugccugcagaagcagagccacugggucgagaucaccgcgcugauccucggggcccaggcccugcccguguaccugaugacgcucaugaagggcgccucccggcgcagcuggccccugaacgaggggaucauggcggugggccuggucucccuccuggggagcgcccugcucaagaacgacgugccgcuggccggccccaugguggccggcgggcugcuccuggccgcguacgucauguccggcagcagcgccgaccugucccucgagaaggccgccaacgugcagugggacgagauggccgacaucaccgggagcucccccaucaucgaggugaagcaggacgaggacggcagcuucuccauccgggacgucgaggagaccaacaugaucacccugcuggugaagcucgcgcugaucacggugagcgggcuguacccccucgccaucccgaucaccaugacccugugguacauguggcaggucaagacccagcgcuccggcgcccugugggacgugcccagccccgccgccacccagaaggcggcccucuccgagggcguguaccggaucaugcagcgcgggcuguucggcaagacgcaggucggggugggcauccacauggaggggguguuccacaccauguggcacgucacccggggcagcgugaucugccacgagaccggccgccuggagcccuccugggccgacgugcgcaacgacaugaucagcuacgggggcggguggcggcucggcgacaagugggacaaggaggaggacguccaggugcuggccaucgagccgggcaagaaccccaagcacgugcagacgaagcccgggcuguucaagacccucaccggcgagaucggggccgucacccuggacuucaagcccggcacguccgggagcccgaucaucaaccgcaagggcaaggugaucggccuguacgggaacggcguggucaccaaguccggggacuacgugagcgcgaucacccaggccgagcggaucggcgagcccgacuacgagguggacgaggacaucuuccgcaagaagcggcucaccaucauggaccugcaccccggggccggcaagacgaagcgcauccugccguccaucguccgggaggcccugaagcgccggcuccgcacccugauccuggcgcccacccgggugguggccgccgagauggaggaggcccuccgcggccugcccauccgguaccagacccccgccgucaagagcgagcacacggggcgcgagaucguggaccugaugugccacgcgaccuucaccacccggcuccuguccagcacgcgcgugccgaacuacaaccugaucgucauggacgaggcccacuucaccgaccccagcuccguggccgcccggggcuacaucagcacccgcguggagaugggggaggccgcggccaucuucaugaccgccacgccgcccggcgccaccgacccguucccccaguccaacagccccaucgaggacaucgagcgggagauccccgagcgcuccuggaacaccggguucgacuggaucaccgacuaccagggcaagacggucugguucgugccgagcaucaaggccggcaacgacaucgcgaacugccuccgcaaguccgggaagaaggucauccagcugagccggaagaccuucgacaccgaguaccccaagaccaagcugacggacugggacuucguggugaccaccgacaucuccgagaugggcgccaacuuccgcgccgggcgggucaucgacccccgccggugccucaagcccgugauccugaccgacggcccggagcgcgugauccuggccgggcccauccccgucacgcccgcgagcgccgcccagcggcgcggccggaucggccgcaacccggcccaggaggacgaccaguacguguucuccggggacccccucaagaacgacgaggaccacgcccacuggaccgaggcgaagaugcugcuggacaacaucuacacccccgagggcaucauccccacccucuucgggccggagcgggagaagacgcaggccaucgacggcgaguuccgccugcggggcgagcagcgcaagaccuucguggagcugaugcggcgcggggaccuccccgucuggcugagcuacaagguggccuccgccggcaucagcuacaaggaccgggaguggugcuucaccggggagcgcaacaaccagauccuggaggagaacauggagguggagaucuggacccgggagggcgagaagaagaagcuccgccccaaguggcuggacgcccgggucuacgcggaccccauggcccugaaggacuucaaggaguucgccuccgggcgcaagagcaucacccucgacauccugacggagaucgccucccugccgaccuaccucagcucccgcgccaagcuggcgcuggacaacaucgugaugcuccacaccaccgagcggggcggccgcgccuaccagcacgcccugaacgagcugcccgagagccucgagacgcugaugcugguggcccuccugggggcgaugaccgccggcaucuuccuguucuucaugcaggggaagggcaucgggaagcucagcaugggccugaucaccaucgccgucgccuccggccugcucuggguggccgagauccagccccaguggaucgcggccagcaucauccuggaguucuuccugauggugcuccugaucccggagcccgagaagcagcggacgccccaggacaaccagcugaucuacgucauccucacgauccugaccaucaucgggcugaucgccgccaacgagaugggccucaucgagaagaccaagaccgacuucggguucuaccaggugaagacggagaccaccauccuggacguggaccugcgccccgccuccgcguggacccucuacgccgucgccacgaccauccugaccccgaugcugcggcacaccaucgagaacacgagcgccaaccucucccuggccgcgaucgccaaccaggccgccgugcugaugggccucgggaagggcuggccccugcaccgcauggaccugggcgugccccuccuggccauggggugcuacagccaggucaaccccaccacccugaccgcgucccucgugaugcugcuggugcacuacgccaucaucggcccggggcuccaggccaaggccacgcgggaggcgcagaagcgcaccgccgccggcaucaugaagaaccccaccgucgacggcaucaccgugaucgaccuggagcccaucagcuacgaccccaaguucgagaagcagcugggccaggugaugcuccugguccugugcgccggccagcuccugcugaugcggacgaccugggccuucugcgaggugcucacccuggcgaccgggccgauccugacgcucugggagggcaaccccgggcgcuucuggaacaccaccaucgccguguccaccgccaacaucuuccggggcagcuaccuggccggcgccgggcuggcguucucccucaucaagaacgcccagacgccccgccggggcaccgggaccaccggcgagacccugggggagaaguggaagcgccagcugaacagccucgaccggaaggaguucgaggaguacaagcgcuccggcauccuggaggucgaccggacggaggccaagagcgcccugaaggacggcuccaagaucaagcacgccgugagccgcggguccagcaagauccgguggaucguggagcgcggcauggucaagcccaaggggaaggugaucgaccucggcugcgggcgcggcggcugguccuacuacauggcgacccugaagaacgugaccgaggucaagggguacaccaagggcgggccgggccacgaggagcccauccccauggccacguacggguggaaccuggugaagcuccacagcggcguggacgucuucuacaagcccaccgagcaggucgacacccugcugugcgacaucggcgagagcuccagcaacccgaccaucgaggaggggcggacgcuccgcgugcugaagauggucgagcccuggcuguccagcaagcccgaguucugcaucaaggugcugaaccccuacaugccgaccgugaucgaggagcucgagaagcugcagcggaagcacggcgggaaccugguccgcugcccccucucccggaacagcacccacgagauguacuggguguccggcgccagcggcaacaucguguccagcgucaacaccacguccaagaugcugcugaaccgcuucaccacccggcaccgcaagcccaccuacgagaaggacguggaccucggggccggcacgcggagcgucuccaccgagaccgagaagcccgacaugaccaucaucgggcgccggcugcagcgccugcaggaggagcacaaggagacguggcacuacgaccaggagaacccguaccggaccugggcguaccacggcagcuacgaggcccccuccaccgggagcgccuccagcauggugaacggcguggucaagcuccugaccaagcccugggacgugaucccgauggugacgcagcuggccaugaccgacaccacccccuucggccagcagcgcgucuucaaggagaagguggacacgcggacgccccagcccaagccggggacccgcauggugaugaccacgaccgccaacuggcucugggcgcugcugggcaagaagaagaacccccggcucugcacccgcgaggaguucaucuccaagguccggagcaacgccgccaucggggccguguuccaggaggagcagggcuggaccagcgccuccgaggcggugaacgacagccgcuucugggagcuggucgacaaggagcgggcccugcaccaggaggggaagugcgaguccugcguguacaacaugaugggcaagcgcgagaagaagcucggcgaguucgggcgcgccaagggcagccgggccaucugguacauguggcugggggcccgcuuccuggaguucgaggcgcucggcuuccugaacgaggaccacugguucgggcgggagaacuccuggagcggcguggagggcgaggggcugcaccgccucggcuacauccuggaggagaucgacaagaaggacggggaccugauguacgccgacgacacggccggcugggacacccggaucaccgaggacgaccuccagaacgaggagcugaucaccgagcagauggcgccccaccacaagauccuggcgaaggccaucuucaagcucaccuaccagaacaaggucgugaaggugcugcgccccacgccgcggggcgccgucauggacaucaucucccgcaaggaccagcgggggagcggccagguggggaccuacggccugaacaccuucaccaacauggaggugcagcucauccgccagauggaggccgagggggucaucacgcaggacgacaugcagaaccccaagggccugaaggagcggguggagaaguggcugcgcgagugcggcguggaccggcucaagcgcauggccaucuccggggacgacugcgucgugaagccccuggacgagcgguucggcaccagccuccuguuccugaacgacauggggaaggugcgcaaggacaucccccagugggagccguccaagggcuggaagaacuggcaggagguccccuucugcagccaccacuuccacaagaucuucaugaaggacgggcggucccugguggugcccugccgcaaccaggacgagcucaucggccgggcgcgcaucagccagggcgccggguggucccugcgcgagaccgccugccugggcaaggccuacgcccagauguggagccucauguacuuccaccggcgcgaccugcggcuggcguccauggccaucugcagcgccguccccaccgagugguucccgacgagccgcaccaccugguccauccacgcccaccaccaguggaugaccacggaggacaugcucaagguguggaaccggguguggaucgaggacaaccccaacaugaucgacaagacccccguccacagcugggaggacauccccuaccuggggaagcgcgaggaccuguggugcggcucccucaucgggcugagcucccgggccaccugggcgaagaacauccacaccgccaucacccaggugcgcaaccugaucggcaaggaggaguacguggacuacaugccggucaugaagcgguacagcgcccccuccgagagcgagggcgugcucuga

SEQ ID NO: 10530 - RNA, 9867 nt, Artificial Sequence
  derived and/or modified CDS sequence (opt1) from DENV-4__KT276273__SS-prME
agcaccaucacccugcucugccugauccccacggugauggccuuccaccuguccacccgcgacggcgagccgcucaugaucgucgccaagcacgagcgggggcgcccccugcuguucaagaccaccgagggcaucaacaagugcacgcucaucgcgauggaccugggggagaugugcgaggacaccgugaccuacaagugcccccugcucgugaacaccgagcccgaggacaucgacugcuggugcaaccugacgagcaccugggucauguacggcaccugcacccaguccggggagcggcgccgggagaagcgcagcguggcccugacgccgcacuccggcaugggccucgagacccgggccgagaccuggaugagcuccgagggggccuggaagcacgcccagcgcguggagagcuggauccugcggaaccccggcuucgcgcugcucgccggguucauggccuacaugaucggccagaccgggauccagcgcacggucuucuucgugcugaugaugcugguggcccccuccuacggcaugcggugcgucggcguggggaaccgcgacuucguggagggcgucagcgggggcgcguggguggaccucgugcuggagcacggcgggugcgucaccaccauggcccagggccggcccacccuggacuucgagcucacgaagaccaccgccaaggagguggcccugcugcgcaccuacugcaucgaggccuccaucagcaacaucacgaccgcgacccggugcccgacccagggggagcccuaccucaaggaggagcaggaccagcaguacaucugccgccgggacguggucgaccgcggcugggggaacggcugcggccuguucgggaagggcgggguggugacgugcgccaaguucuccugcagcggcaagaucaccgggaaccugguccagaucgagaaccucgaguacaccgugguggucaccgugcacaacggcgacacgcacgccgucggcaacgacaccuccaaccacggggugaccgccaccaucacgccccggagccccuccguggaggucgagcugccggacuacggcgagcugacccucgacugcgagccccgcagcgggaucgacuucaacgagaugauccugaugaagaugaacaagaagaccuggcuggugcacaagcagugguuccucgaccugccccugcccuggaccgccggcgcggacaccuccgaggugcacuggaacaacaaggagcggauggucacguucaaggugccgcacgccaagcgccaggacgugaccguccucgggagccaggagggcgccaugcacagcgcccuggccggcgcgaccgagguggacuccggggacggcaaccacauguucgccgggcaccugaagugcaaggugcgcauggagaagcuccggaucaagggcaugagcuacaccaugugcuccggcaaguucagcaucgacaaggagauggccgagacgcagcacgggaccaccgucgugaaggugaaguacgagggcgccggggcccccugcaagguccccaucgagauccgcgacgugaacaaggagaaggugaucggccgggucaucuccagcaucccccuggcggagaacaccaacuccgugacgaacaucgagcuggagccgcccuucggggacagcuacaucgugaucggcgucggcaacuccgcccucacccugcacugguuccgcaaggggagcuccaucggcaagauguucgagagcaccuaccggggggccaagcgcauggccauccugggcgagaccgcgugggacuucggguccgugggcggccucuucacgagccuggggaaggccgugcaccaggucuucggcuccguguacaccaccauguucgggggcgugagcuggaugauccggauccugaucggguuccucguccuguggaucggcaccaacucccgcaacacgagcauggccaugaccugcaucgccgugggcgggaucacccuguuccugggcuucaccgugcaggccgacauggggugcgucguguccuggagcggccgggagcucaagugcgggagcggcaucuucgugaucgacaacguccacacguggaccgagcaguacaaguuccagcccgagucccccgcgcgccuggccagcgccauccugaacgcccacaaggacggcgugugcgggauccgguccaccacccgccucgagaacgugauguggaagcagaucacgaacgagcugaacuacguccugugggagggcgggcacgaccucaccgugguggccggcgacgucaagggcgugcugaccaaggggaagcgggcgcugaccccgcccgccagcgaccucaaguacuccuggaagacguggggcaaggccaagaucuucacccccgaggcccgcaacagcaccuuccugaucgacgggcccgacaccuccgagugcccgaacgagcggcgcgccuggaacagccuggagguggaggacuacggcuucgggauguucacgaccaacaucuggaugaaguuccgggagggcuccagcgagaugugcgaccaccgccucauguccgcggccaucaaggaccagaaggccguccacgccgacaugggcuacuggaucgagagcuccaagaaccagaccuggcagaucgagaaggcgagccugaucgaggugaagaccugccuguggcccaagacgcacacccucugguccaacggggugcuggagagccagaugcugauccccaaguccuacgccggcccguucagccagcacaacuaccggcagggguacgccacccagaucgccggccccuggcaccucgggaagcuggagaucgacuucggcgagugccccggcaccaccgucacgauccaggaggacugcgaccaccgcgggcccagccugcgcaccaccaccgccuccggcaagcucgugacgcaguggugcugccggagcugcaccaugccgccccugcgcuuccugggggaggacggcugcugguacgggauggagauccggccccucuccgagaaggaggagaacauggugaagagccaggucgcggccggccagggcaccuccgagaccuucagcauggggcugcugugccucacgcuguucguggaggagugccugcgccggcgcgugacccggaagcacaugauccucgucguggucaucaccuucugcgccaucauccugggcgggcugaccuggauggaccuccugcgcgcccugaucaugcucggcgacacgauguccggccggaucgggggccagauccaccuggccaucauggcgguguucaagaugagccccggguacgugcugggcgucuuccuccgcaagcugaccucccgggagaccgcccugauggugaucgggauggccaugaccacggugcucagcaucccguacgaccugauggagcugaucgacggcaucucccucggccugauccugcucaagaucgucacccaguucgacaacacccagguggggacccuggcccugagccucacguucauccgcuccaccaugccccuggugauggccuggcggaccaucauggcgguccuguucguggugacccucaucccccugugccgcacgagcugccugcagaagcagucccacugggucgagaucaccgcccucauccugggcgcccaggcccugcccguguaccucaugacccugaugaagggggcgagccggcgcuccuggccgcugaacgagggcaucauggccguggggcucgucagccugcugggcuccgcccuccugaagaacgacgugccccuggccggccccaugguggccgggggccuccugcuggcggccuacgucaugagcgggagcuccgccgaccucagccuggagaaggccgccaacgugcagugggacgagauggcggacaucaccggcuccagccccaucaucgaggugaagcaggacgaggacggguccuucagcauccgggacgucgaggagacgaacaugaucacccugcucgugaagcuggcccugaucaccguguccggccucuacccgcuggccauccccgucaccaugacgcugugguacauguggcaggugaagacccagcgcagcggcgcccucugggacgugcccucccccgccgcgacccagaaggccgcccugagcgagggggucuaccggaucaugcagcgcggccuguucgggaagacccaggugggcguggggauccacauggagggcgucuuccacacgauguggcacgugacccggggcuccgugaucugccacgagaccgggcgccucgagccgagcugggccgacguccgcaacgacaugaucuccuacggcgggggcuggcggcugggcgacaagugggacaaggaggaggacgugcaggugcuggccaucgagcccgggaagaaccccaagcacguccagaccaagcccggccucuucaagacccugacgggggagaucggcgcggugacccuggacuucaagccggggaccagcggcucccccaucaucaaccgcaagggcaaggugaucgggcucuacggcaacggggucgugaccaagagcggcgacuacguguccgccaucacgcaggccgagcggaucggggagcccgacuacgaggucgacgaggacaucuuccgcaagaagcggcugaccaucauggaccugcacccgggcgccggcaagaccaagcgcauccuccccagcaucgugcgggaggcgcugaagcgccggcugcgcacccugauccucgcccccacgcggguggucgccgccgagauggaggaggcccugcgcgggcugcccauccgguaccagaccccggcggugaaguccgagcacaccggccgcgagaucguggaccucaugugccacgccaccuucacgacccggcugcugagcagcacccgcguccccaacuacaaccucaucgugauggacgaggcccacuucaccgaccccuccagcguggccgcccggggguacaucuccacgcgcgucgagaugggcgaggcggccgccaucuucaugaccgccacccccccgggggccaccgaccccuucccccagagcaacucccccaucgaggacaucgagcgggagaucccggagcgcagcuggaacacgggcuucgacuggaucaccgacuaccagggcaagaccgugugguucguccccuccaucaaggcggggaacgacaucgccaacugccugcgcaagagcggcaagaaggugauccagcugucccggaagaccuucgacacggaguaccccaagaccaagcucaccgacugggacuucguggucaccacggacaucagcgagaugggggccaacuuccgcgccggccgggugaucgacccccgccggugccugaagccggugauccugaccgacgggcccgagcgcgucauccucgcgggccccauccccgugaccccggccuccgccgcccagcggcgcggccggaucgggcgcaaccccgcccaggaggacgaccaguacguguucagcggcgacccccugaagaacgacgaggaccacgcgcacuggaccgaggccaagaugcugcucgacaacaucuacacgcccgaggggaucaucccgacccuguucggccccgagcgggagaagacccaggccaucgacggcgaguuccgccugcggggggagcagcgcaagaccuucgucgagcucaugcggcgcggcgaccugcccguguggcuguccuacaagguggccagcgccgggaucuccuacaaggaccgggaguggugcuucacgggcgagcgcaacaaccagauccucgaggagaacauggaggucgagaucuggacccgggagggggagaagaagaagcugcgcccccgguggcuggacgcgcgcguguacgccgacccgauggcccucaaggacuucaaggaguucgccagcggccgcaaguccaucacccuggacauccugaccgagaucgccagccuccccacguaccuguccagccgggcgaagcuggcccucgacaacaucgugaugcugcacaccaccgagcgcggcgggcgggccuaccagcacgcccugaacgagcuccccgagagccuggagacccugaugcucgucgcgcugcugggcgccaugaccgccgggaucuuccucuucuucaugcagggcaaggggaucggcaagcuguccaugggccugaucacgaucgccguggccagcgggcuccuguggguggcggagauccagccgcaguggaucgccgccuccaucauccuggaguucuuccucaugguccugcugauccccgagcccgagaagcagcgcaccccccaggacaaccagcucaucuacgugauccugaccauccugaccaucaucggccucaucgccgccaacgagauggggcugaucgagaagacgaagaccgacuucggcuucuaccaggugaagaccgagaccacgauccuggacgucgaccuccggccggcgagcgccuggacccuguacgccguggccaccaccauccugacgcccaugcuccgccacaccaucgagaacaccuccgccaaccugagccuggcggccaucgccaaccaggccgccgugcucauggggcugggcaagggcuggccccugcaccggauggaccucggggucccccugcuggcgaugggcugcuacucccaggugaacccgaccacgcucaccgccagccuggugaugcugcucguccacuacgccaucaucgggcccggccugcaggccaaggcgacccgcgaggcccagaagcggaccgccgccggcaucaugaagaaccccacgguggacgggaucaccgugaucgaccuggagcccaucuccuacgacccgaaguucgagaagcagcucggccaggucaugcugcuggugcucugcgccgggcagcugcugcucaugcgcaccaccugggcguucugcgaggugcugacgcuggccaccggccccauccucacccugugggaggggaaccccggccgguucuggaacaccacgaucgccgucagcaccgccaacaucuuccgcggcuccuaccuggccggggcgggccucgccuucagccugaucaagaacgcccagaccccccggcgcgggaccggcacgaccggggagacccugggcgagaaguggaagcggcagcucaacucccuggaccgcaaggaguucgaggaguacaagcggagcggcauccuggagguggaccgcaccgaggccaaguccgcccucaaggacgggagcaagaucaagcacgcggugucccggggcagcuccaagauccgcuggaucgucgagcgcgggauggugaagccgaagggcaagguggucgaccuggggugcggccggggcggguggagcuacuacauggccacgcugaagaacgugaccgaggugaagggcuacaccaaggggggccccgggcacgaggagcccauccccauggccaccuacggcuggaaccucgucaagcugcacagcggcguggacguguucuacaagccgaccgagcaggucgacacgcugcucugcgacaucggggaguccagcuccaaccccaccaucgaggagggccgcacccugcgggugcugaagaugguggagcccuggcucagcuccaagcccgaguucugcaucaagguccugaacccguacaugcccaccgugaucgaggagcuggagaagcugcagcgcaagcacgggggcaaccucgugcggugcccccugagccgcaacuccacgcacgagauguacugggucagcggcgccuccgggaacaucgugagcuccgucaacaccaccagcaagaugcugcucaaccgguucaccacgcgccaccggaagcccaccuacgagaaggacguggaccugggcgcggggacccgcuccgugagcaccgagacggagaagccggacaugaccaucaucggccggcgccugcagcggcuccaggaggagcacaaggagaccuggcacuacgaccaggagaaccccuaccgcaccugggccuaccacggguccuacgaggcccccagcacgggcuccgccagcuccauggucaacggcguggugaagcugcugaccaagccgugggacgucauccccauggugacccagcucgccaugaccgacacgacccccuucgggcagcagcggguguucaaggagaaggucgacacccgcaccccccagccgaagcccggcacgcggauggugaugaccaccaccgcgaacuggcugugggcccugcucgggaagaagaagaacccccgccugugcacgaaggaggaguucaucagcaaggugcgggccaacgccgccaucggcgcggucuuccaggaggagcagggguggaccagcgccuccgaggccgugaacgacagccgcuucugggagcugguggacaaggagcgggcccuccaccaggagggcaagugcgaguccugcgucuacaacaugaugggcaagcgcgagaagaagcugggggaguucggccgcgccaaggggagccgggcgaucugguacauguggcugggcgcccgcuuccucgaguucgaggcccugggguuccugaacgaggaccacugguucggccgggagaacuccuggagcggcguggagggggagggccuccaccgccugggguacauccuggaggagaucgacaagaaggacggcgaccucauguacgccgacgacaccgcgggcugggacacccggaucacggaggacgaccugcagaacgaggagcugaucaccgagcagauggccccccaccacaagauccucgccaaggccaucuucaagcugaccuaccagaacaagguggucaaggugcugcgcccgaccccccggggggccgugauggacaucaucucccgcaaggaccagcggggcagcgggcaggucggcacguacgggcucaacaccuucaccaacauggaggugcagcugauccgccagauggaggcggagggcgugaucacccaggacgacaugcagaaccccaagggccugaaggagcgggucgagaaguggcuccgcgagugcgggguggaccggcugaagcgcauggccaucuccggcgacgacugcguggucaagccccuggacgagcgguucgccaccagccuccuguuccugaacgacauggggaaggugcgcaaggacaucccgcagugggagcccuccaagggcuggaagaacuggcaggaggugcccuucugcagccaccacuuccacaagaucuucaugaaggacgggcggucccucgucgugcccugccgcaaccaggacgagcugaucggccgggcccgcaucagccagggcgccggguggucccugaaggagacggcgugccucgccaaggccuacgcccagauguggagccugauguacuuccaccgccgggaccugcgccucgccuccauggcgaucugcagcgccgugccgaccgagugguuccccaccagccggaccacgugguccauccacgcccaccaccaguggaugaccaccgaggacaugcugaaggucuggaaccgcguguggaucgaggacaaccccaacaugaucgacaagacccccgugcacagcugggaggacaucccguaccugggcaagcgggaggaccucuggugcgggucccugaucggccugagcucccgcgccacgugggccaagaacauccacaccgcgaucacccagguccggaaccucaucgggaaggaggaguacauggacuacaugcccgugaugcgccgguacagcgcccccuccgagagcgagggcgugcuguga

SEQ ID NO: 10531 - RNA, 9867 nt, Artificial Sequence
  derived and/or modified CDS sequence (opt1) from DENV-4__KU523872__SS-prME
agcaccaugacccugcucugccugauccccaccgugauggccuuccaccugagcacccgcgacggcgagccgcucaugaucguggccaagcacgagcgggggcgcccccugcuguucaagaccaccgagggcaucaacaagugcacccucaucgcgauggaccugggggagaugugcgaggacaccgugaccuacaagugcccccugcucgugaacaccgagcccgaggacaucgacugcuggugcaaccugaccagcaccugggucauguacgggaccugcacccaguccggggagcggcgccgggagaagcgcagcguggcccugaccccgcacuccggcaugggccucgagacccgggccgagaccuggaugagcuccgagggggccuggaagcacgcccagcgcguggagagcuggauccugcggaaccccggcuucgcgcugcucgccggguucauggcccacaugaucggccagaccgggauccagcgcacggucuucuucgugcugaugaugcugguggcccccuccuacggcaugcggugcgucggcguggggaaccgcgacuucguggagggcgucagcgggggcgcguggguggaccucgugcuggagcacggcgggugcgucaccaccauggcccagggcaagcccacccuggacuucgagcucacgaagaccaccgccaaggagguggcccugcugcggaccuacugcaucgaggccuccaucagcaacaucacgaccgcgacccgcugcccgacccagggggagcccuaccucaaggaggagcaggaccagcaguacaucugccggcgcgacguggucgaccggggcugggggaacggcugcggccuguucgggaagggcgggguggugacgugcgccaaguucuccugcagcggcaagaucaccgggaaccugguccagaucgagaaccucgaguacaccgugguggucaccgugcacaacggcgacacgcacgccgucggcaacgacaccuccaaccacggggugaccgccaccaucacgccccgcagccccuccguggaggucaagcugccggacuacggcgagcugacccucgacugcgagccccggagcgggaucgacuucaacgagaugauccugaugaagaugaagaagaagaccuggcuggugcacaagcagugguuccucgaccugccccugcccuggaccgccggcgcggacaccuccgaggugcacuggaacuacaaggagcgcauggucacguucaaggugccgcacgccaagcggcaggacgugaccguccucgggagccaggagggcgccaugcacagcgcccuggccggcgcgaccgagguggacuccggggacggcaaccacauguucgccgggcaccugaagugcaaggugcgcauggagaagcuccgcaucaagggcaugagcuacaccaugugcuccggcaaguucagcaucgacaaggagauggccgagacgcagcacgggaccaccgucgugaaggugaaguacgagggcgccggggcccccugcaagguccccaucgagauccgggacgugaacaaggagaagguggucggccgcaucaucuccagcacccccuucgcggagaacacgaacuccgugaccaacaucgagcuggagccgcccuucggggacagcuacaucgugaucggcgucggcgacuccgcccugacccuccacugguuccggaaggggagcuccaucggcaagauguucgagagcaccuaccgcggggccaagcggauggccauccugggcgagacggcgugggacuucggguccgugggcggccuguucaccagccucgggaaggccgugcaccaggucuucggcuccguguacaccaccauguucgggggcgugagcuggaugauccgcauccugaucggguuccugguccucuggaucggcacgaacucccggaacaccagcauggccaugaccugcaucgccgugggcgggaucacccuguuccugggcuucacggugcaggccgacauggggugcgucguguccuggaacggcaaggagcugaagugcgggaacggcaucuucguggucgacaacgugcacaccuggaccgagcaguacaaguuccagcccgagagccccgcgcgccucgccagcgccauccugaacgcccacaaggacggcgugugcgggauccgguccaccacgcgccuggagaacgucauguggaagcagaucaccaacgagcucaacuacgugcugugggagggcgggcacgaccugaccguggucgccggcgacgugaagggcgugcucaccaaggggaagcgggcgcugacgccgcccgucaacgaccugaaguacagcuggaagaccuggggcaaggccaagaucuucacccccgaggcccgcaacuccaccuuccucaucgacgggcccgacacgagcgagugcccgaacgagcggcgcgccuggaacuucuucgagguggaggacuacggcuucgggauguucaccaccaacaucuggaugaaguuccgggagggcuccagcgaggugugcgaccaccgccugauguccgccgcgaucaaggaccagaaggccguccacgccgacaugggcuacuggaucgagagcuccaagaaccagaccuggcagaucgagaaggccagccugaucgaggugaagacgugccucuggcccaagacccacacccugugguccaacggggugcuggagagccagaugcucaucccccgguccuacgcgggcccguucagccagcacaacuaccgccagggguacgccacccagaccgccggccccuggcaccuggggaagcuggagaucgacuucggcgagugccccggcacgaccgucaccauccaggaggacugcgaccaccgggggcccucccuccgcaccacgaccgccagcggcaagcuggugacccaguggugcugccgcuccugcaccaugccgccccugcgguuccucggggaggacggcugcugguacgggauggagauccgcccccugagcgagaaggaggagaacauggucaagagccaggucacggccggccagggcaccuccgagaccuucagcauggggcugcucugccugacccuguucguggaggagugccuccggcgccgggucacgcgcaagcacaugauccuggugguggucaucaccuucugcgcgaucauccugggcgggcucaccuggguggaccugcugcgggcccucaucaugcugggcgacaccauguccggccgcaucgggggccagauccaccuggccaucauggccguguucaagaugagccccggguacguccucggcguguuccugcggaagcugacgucccgcgagaccgcccucauggugaucgggauggcgaugaccaccgucuucagcaucccgcacgaccugauggagcugaucgacggcaucucccucggccugauccugcucaagaucgugacgcacuucgacaacacccagguggggacccuggcccugagccucaccuucauccgguccacgacgccccuggucauggccuggcgcaccaucauggccguguucuucguggucacccugaucccccucugccggacgagcugccugcagaagcagucccacuggguggagaucaccgcccugauccucggcgcgcaggcccugcccguguaccugaugacccucaugaagggggccagccgccgguccuggccgcugaacgagggcaucauggccgucgggcuggugagccuccugggcuccgcgcugcucaagaacgacgugccccuggccggccccauggucgccgggggccugcuccuggccgccuacgugaugagcggguccagcgcggaccugucccucgagaaggccgccaacgugcagugggacgagauggccgacaucaccggcagcagccccgucaucgaggugaagcaggacgaggacggguccuucagcauccgcgacguggaggagacgaacaugaucacccugcuggucaagcucgcccugaucaccguguccggccuguacccgcucgcgauccccgugaccauggccaucugguacaucuggcaggucaagacgcagcggagcggcgcccugugggacgugcccucccccgccgccacccagaaggcgacccugagcgaggggguguaccgcaucaugcagcggggccucuucgggaagacccaggucggcguggggauccacauggagggcguguuccacaccauguggcacgucacgcgcggcuccgugaucugccacgagaccgggcggcuggagccgagcugggccgacgugcgcaacgacaugaucuccuacggcgggggcuggaagcugggcgacaagugggacaaggaggaggacguccaggugcucgccaucgagcccgggaagaaccccaagcacgugcagaccaagcccggccuguucaagacccugacgggggagaucggcgccgucacccucgacuucaagccggggaccagcggcucccccaucaucaacaagaagggcaaggugaucgggcuguacggcaacgggguggucaccaagagcggcgacuacguguccgccaucacgcaggcggagcgcaucggggagcccgacuacgagguggacgaggacaucuuccggaagaagcgccugaccaucauggaccuccacccgggcgccggcaagaccaagcggauccugcccagcaucguccgcgaggcccugaagcggcgccuccggacccugauccuggcccccacgcgcgugguggcggccgagauggaggaggcccuccgggggcugcccauccgcuaccagaccccggccgucaaguccgagcacaccggccgggagaucguggaccugaugugccacgccaccuucacgacccgccugcucagcuccacccggguccccaacuacaaccugaucgugauggacgaggcgcacuucaccgaccccugcagcguggccgcccgcggguacaucuccacgcgggucgagaugggcgaggccgccgcgaucuucaugaccgccacgcccccggggagcaucgaccccuucccccagagcaacucccccaucgaggacaucgagcgcgagaucccggagcggagcuggaacaccggcuucgacuggaucacggacuaccagggcaagaccgugugguucgugcccuccaucaaggccgggaacgacaucgccaacugccugcgcaagagcggcaagcgggucauccagcucucccgcaagaccuucgacaccgaguaccccaagacgaagcugaccgacugggacuucguggugaccaccgacaucagcgagaugggggccaacuuccgcgcgggccgggucaucgacccccgccggugccugaagccggugauccucacggacgggcccgagcgcgugauccuggccggccccauccccgucaccccggccuccgccgcgcagcggcgcggccggaucgggcgcaaccccgcccaggaggacgaccaguacguguucagcggcgacccccugcggaacgacgaggaccacgcccacuggaccgaggccaagaugcuccuggacaacaucuacacccccgaggggaucaucccgacgcuguucggccccgagcgcgagaagacccaggccaucgacggcgaguuccggcuccgcggggagcagcggaagaccuucguggagcugaugcgccggggcgaccugcccgucuggcucuccuacaagguggcgagcgccgggaucuccuacaaggaccgcgaguggugcuucaccggcgagcggaacaaccagauccuggaggagaacauggagguggagaucuggacgcgcgagggggagaagaagaagcugcggcccaaguggcucgacgcccgcgucuacgccgacccgauggcccugaaggacuucaaggaguucgcgagcggccggaaguccaucacccuggacauccucaccgagaucgccacccugcccaccuaccugagcuccaaggccaagcucgcccuggacaacaucgugaugcugcacacgaccgagaagggcgggcgcgccuaccagcacgcgcucaacgagcugcccgagagccuggagacccucaugcugguggcccugcucggcgccaugaccgccgggaucuuccuguucuucaugcagggcaaggggaucggcaagcuguccaugggccucaucgcgaucgccgucgccagcgggcugcuguggguggccgagauccagccgcaguggaucgccgcguccaucauccucgaguucuuccugauggugcugcucauccccgagcccgagaagcagcgcacgccccaggacaaccagcugaucuacgucauccugaccauccucaccaucaucggccugguggccgccaacgagauggggcugaucgagaagaccaagacggacuucggcuucuaccaggugaagaccgagaccaccauccucgacgucgaccugcggccggccagcgccuggacgcuguacgcgguggccaccaccauccucacccccaugcugcgccacacgaucgagaacaccagcgccaaccugucccucgccgccaucgcgaaccaggccgccgugcugauggggcugggcaagggcuggccccuccaccggauggaccugggggucccccugcucgccaucggcugcuacagccaggugaacccgaccacccugacggccucccuggugaugcuccugguccacuacgcgaucaucgggcccggccugcaggccaaggccacccgcgaggcccagaagcggaccgcggccggcaucaugaagaaccccaccguggacgggaucacggugaucgaccucgagcccaucagcuacgacccgaaguucgagaagcagcugggccaggucaugcugcucgugcugugcguggggcagcugcuccugaugcgcaccaccugggcccugugcgagguccucacccuggccacgggccccaucaugacccugugggaggggaaccccggccgguucuggaacaccaccaucgccguguccacggcgaacaucuuccgcggcagcuaccucgccggggccggccuggccuucucccugaucaagaacgcccagacgccccggcgcgggaccggcaccacgggggagacccucggcgagaaguggaagcggcagcugaacagccuggaccgcaaggaguucgaggaguacaagcgguccggcauccucgagguggaccgcaccgaggccaagagcgcccugcgggacggguccaagaccaagcacgccgucagccgcggcuccagcaagauccgguggaucguggagcgcgggaugaucaagccgaagggcaagguggucgaccuggggugcggccggggcgggugguccuacuacauggccacccucaagaacgugacggaggugaagggcuacaccaagggcggccccgggcacgaggagcccauccccauggccaccuacggcuggaaccuggucaagcugcacagcggcguggacguguucuacaagccgaccgagcaggucgacacgcuccugugcgacaucggggaguccagcuccaaccccaccaucgaggagggcaagacccugcgcgugcucaagauggucgagcccuggcugagcagcaagcccgaguucugcaucaaggugcugaacccguacaugcccaccgugaucgaggagcucgagaagcugcagcgccggcacgggggcucccugguccgcugcccccucagccggaacuccacgcacgagauguacugggugagcggcgcguccgggaacaucgugagcuccgucaacaccaucagcaagaugcugcugaaccgcuucaccacccgguaccgcaagcccacguacgagaaggacguggaccugggcgccgggacccgguccgugagcaccgagaccgagaagccggacaugacgaucaucggccgccggcuccagcgccugcgggaggagcacaaggagaccuggcacuacgaccaggagaaccccuaccgcaccugggccuaccacggguccuacgaggcccccagcaccggcuccgcgagcuccauggucaacggcguggugaagcugcucacgaagccgugggacgucgugcccauggugacccagcuggccaugaccgacaccacgcccuucgggcagcagcgggucuucaaggagaagguggacacccgcacgccccagccgaagcccggcacccggaagaucaugacgaccaccgccaacuggcugugggcccuccuggggaagaagaaguccccgcgccugugcacccgggaggaguucaucuccaaggugcgcagcaacgccgcgaucggcgccgucuuccaggaggagcagggguggacguccgccagcgaggccgugaacgacagccgguucugggagcucguggacaaggagcgcgcccugcaccaggagggccggugcgaguccugcgucuacaacaugaugggcaagcgcgagaagaagcugggggaguucggccgcgcgaaggggagccgggccaucugguacauguggcucggcgcccgcuuccuggaguucgaggcccugggguuccucaacgaggaccacugguucucccgggagaacagcugguccggcguggagggcgaggggcugcaccgccugggcuacauccucgaggacaucgacaagaaggacggggaccugaucuacgccgacgacaccgcgggcugggacacccggaucaccgaggacgaccugcucaacgaggagcugaucacggagcagauggcgccccaccacaagacccuggccaaggccaucuucaagcucaccuaccagaacaagguggucaaggugcugcgccccacccccaagggcgcggugauggacaucaucagccggaaggaccagcgcggguccggccaggucgggaccuacggccugaacacguucaccaacauggaggugcagcucauccggcagauggaggccgagggggugaucacccaggacgacaugcagaaccccgagggccugaaggagcgcgucgagaaguggcugaaggagugcggcguggaccggcucaagcgcauggccaucagcggggacgacugcguggucaagccccuggacgagcgguucuccaccagccuccuguuccugaacgacaugggcaaggugcgcaaggacaucccgcagugggagcccuccaagggguggaagaacuggcaggaggugcccuucugcagccaccacuuccacaagaucuucaugaaggacggccggucccuggucgugcccugccgcaaccaggacgagcucaucgggcgggcccgcaucagccagggcgccggcuggucccugcgggagacggcgugccuggggaaggccuacgcccagauguggagccucauguacuuccaccgccgcgaccugcggcuggccuccauggccaucugcagcgcggugccgaccgagugguuccccaccagccgcaccacgugguccauccacgcccaccaccaguggaugaccaccgaggacaugcucaaggucuggaaccggguguggaucgaggacaaccccaacaugaccgacaagacgcccgugcacagcugggaggacaucccguaccugggcaagcgcgaggaccuguggugcgggucccucaucggccugagcucccgggccaccugggccaagaacauccacaccgccaucacccagguccgcaaccugaucgggaaggaggaguacguggacuacaugcccgcgaugaagcgguacagcgcccccuucgaguccgagggcgugcucuga

SEQ ID NO: 10532 - RNA, 9867 nt, Artificial Sequence
  derived and/or modified CDS sequence (opt1) from DENV-4__KP140942__SS-prME
agcaccaucacccugcucugccugauccccacggugauggccuuccaccuguccacccgggacggcgagccccucaugaucguggccaagcacgagcgggggcgcccccugcuguucaagaccaccgagggcaucaacaagugcacgcucaucgcgauggaccugggggagaugugcgaggacaccgugaccuacaagugcccccugcucgugaacaccgagcccgaggacaucgacugcuggugcaaccugacgagcaccugggugauguacgggaccugcacccaguccggggagcggcgccgggagaagcgcagcguggcccugacgccgcacuccggcaugggccucgagacccgggccgagaccuggaugagcuccgagggggccuggaagcacgcccagcgcguggagagcuggauccugcggaaccccggcuucgcgcugcucgccggguucauggccuacaugaucggccagaccgggauccagcgcacgguguucuucgugcugaugaugcugguggcccccuccuacggcaugcggugcgugggcguggggaaccgcgacuucguggagggcgugagcgggggcgcguggguggaccucgugcuggagcacggcgggugcgucaccaccauggcccagggccggcccacccuggacuucgagcucacgaagaccaccgccaaggagguggcccugcugcgcaccuacugcaucgaggccuccaucagcaacaucacgaccgcgacccggugcccgacccagggggagcccuaccucaaggaggagcaggaccagcaguacaucugccgccgggacguggucgaccgcggcugggggaacggcugcggccuguucgggaagggcgggguggugacgugcgccaaguucuccugcagcggcaagaucaccgggaaccugguccagaucgagaaccucgaguacaccgugguggucaccgugcacaacggcgacacgcacgccgucggcaacgacaccuccaaccacggggugaccgccaccaucacgccccggagccccuccguggaggucgagcugccggacuacggcgagcugacccucgacugcgagccccgcagcgggaucgacuucaacgagaugauccugaugaagaugaacaagaagaccuggcuggugcacaagcagugguuccucgaccugccccugcccuggaccgccggcgcggacaccuccgaggugcacuggaacaacaaggagcggauggucacguucaaggugccgcacgccaagcgccaggacgugaccguccucgggagccaggagggcgccaugcacagcgcccuggccggcgcgaccgagguggacuccggggacggcaaccacauguucgccgggcaccugaagugcaaggugcgcauggagaagcuccggaucaagggcaugagcuacaccaugugcuccggcaaguucagcaucgacaaggagauggccgagacgcagcacgggaccaccgucgugaaggugaaguacgagggcgccggggcccccugcaagguccccaucgagauccgcgacgugaacaaggagaaggugaucggccgggucaucuccagcaucccccuggcggagaacaccaacuccgugacgaacaucgagcuggagccgcccuucggggacagcuacaucgugaucggcgucggcaacuccgcccucacccugcacugguuccgcaaggggagcuccaucggcaagauguucgagagcaccuaccgcggggccaagcgcauggccauccugggcgagaccgcgugggacuucggguccgugggcggccucuucacgagccuggggaaggccgugcaccaggucuucggcuccguguacaccaccauguucgggggcgugagcuggaugauccggauccugaucggguuccucguccuguggaucggcaccaacucccgcaacacgagcauggccaugaccugcaucgccgugggcgggaucacccuguuccugggcuucaccgugcaggccgacauggggugcgucguguccuggagcggccgggagcucaagugcgggagcggcaucuucgugaucgacaacguccacacguggaccgagcaguacaaguuccagcccgagucccccgcgcgccuggccagcgccauccugaacgcccacaaggacggcgugugcgggauccgguccaccacccgccucgagaacgugauguggaagcagaucacgaacgagcugaacuacguccugugggagggcgggcacgaccucaccgugguggccggcgacgucaagggcgugcugaccaaggggaagcgggcgcugaccccgcccgccagcgaccucaaguacuccuggaagacguggggcaaggccaagaucuucacccccgaggcccgcaacagcaccuuccugaucgacgggcccgacaccuccgagugcccgaacgagcggcgcgccuggaacagccuggagguggaggacuacggcuucgggauguucacgaccaacaucuggaugaaguuccgggagggcuccagcgagaugugcgaccaccgccucauguccgcggccaucaaggaccagaaggccguccacgccgacaugggcuacuggaucgagagcuccaagaaccagaccuggcagaucgagaaggcgagccugaucgaggugaagaccugccuguggcccaagacgcacacccucugguccaacggggugcuggagagccagaugcugauccccaaguccuacgccggcccguucagccagcacaacuaccggcagggguacgccacccagaucgccggccccuggcaccucgggaagcuggagaucgacuucggcgagugccccggcaccaccgucacgauccaggaggacugcgaccaccgcgggcccagccugcgcaccaccaccgccuccggcaagcucgugacgcaguggugcugccggagcugcaccaugccgccccugcgcuuccugggggaggacggcugcugguacgggauggagauccggccccucuccgagaaggaggagaacauggucaagagccaggucgcggccggccagggcaccuccgagaccuucagcauggggcugcugugccucacgcuguucguggaggagugccugcgccggcgcgugacccggaagcacaugauccucgccgucgugaucacccugugcgccaucauccugggcgggcucaccuggauggaccugcugcgcgcccucaucaugcugggcgacacgauguccggccggaugggcgggcagacccaccuggcgaucauggccgucuucaagaugagccccggguacgugcucggcguguuccugcgcaagcugaccucccgggagaccgcccucauggucaucgggauggccaugacgaccacccugagcaucccgcacgaccugauggagcucaucgacggcaucucccugggccugauccuccugaagaucgugacccaguucgacaacacccagguggggacccuggcccucagccugaccuucauccgcuccaccaugagccuggucauggcguggcggacgaucauggccguccucuucguggucacccugaucccccugugccgcaccuccugccuccagaagcagagccacuggguggagaucaccgcccugauccugggcgcccaggcgcuccccguguaccugaugacgcugaugaagggggccuccaagcggagcuggccccucaacgagggcaucauggccgucgggcuggugucccugcucggcagcgcccugcugaagaacgacgugccgcucgccggccccauggucgccggcgggcugcugcucgccgccuacgugaugagcggguccagcgccgaccugucccuggagaaggccgcgaacgugcagugggacgagauggccgacaucaccgggagcucccccaucaucgaggucaagcaggacgaggacgggagcuucuccauccgcgacguggaggagaccaacaugaucacccuccuggugaagcuggcccucaucacggucagcggccuguacccccuggccaucccggugaccaugacccucugguacauguggcaggucaagacccagcgguccggcgcccugugggacguccccagccccgcggccacgcagaaggccgcccuguccgaggggguguaccgcaucaugcagcggggccucuucgggaagacccaggugggcgucgggauccacauggagggcguguuccacaccauguggcacgugacccgcggcagcgucaucugccacgagaccgggcggcuggagcccuccugggccgacgugcgcaacgacaugaucagcuacggcgggggcuggcgccugggcgacaagugggacaaggaggaggacgugcagguccucgcgaucgagccggggaagaaccccaagcacgugcagacgaagcccggccuguucaagacccugaccggggagaucggcgccgugacccucgacuucaagcccgggacguccggcagcccgaucaucaaccggaagggcaaggucaucgggcuguacggcaacgggguggugaccaaguccggcgacuacgucagcgccaucacccaggccgagcgcaucggggagcccgacuacgagguggacgaggacaucuuccggaagaagcgccugaccaucauggaccuccaccccggcgcgggcaagacgaagcggauccugccguccaucgugcgcgaggcccugaagcggcgccugcggacccucauccuggcccccacccgcgucguggccgccgagauggaggaggcgcugcgggggcuccccauccgcuaccagacccccgccgucaagagcgagcacacgggccgggagaucgucgaccugaugugccacgccaccuucaccacccgccugcucagcuccacgcgggugccgaacuacaaccugaucgugauggacgaggcccacuucaccgaccccagcuccgucgccgcgcgcggguacaucagcacccggguggagaugggcgaggccgccgccaucuucaugaccgccacgccgcccggggcgaccgacccguucccccaguccaacagccccaucgaggacaucgagcgcgagauccccgagcgguccuggaacaccggcuucgacuggaucaccgacuaccagggcaagacggugugguucgucccgagcaucaaggccgggaacgacaucgccaacugccugcgcaaguccggcaagaaggugauccagcucagccgcaagaccuucgacaccgaguaccccaagaccaagcugacggacugggacuucgucgugaccaccgacaucuccgagaugggggccaacuuccgggcgggccgcgugaucgacccccggcgcugccugaagcccgucauccucaccgacgggccggagcgggugauccuggccggccccauccccgugacgcccgccagcgccgcccagcgccggggccgcaucgggcggaacccggcgcaggaggacgaccaguacgucuucuccggcgacccccugaagaacgacgaggaccacgcccacuggaccgaggccaagaugcuccuggacaacaucuacacccccgaggggaucauccccacccuguucggcccggagcgcgagaagacgcaggccaucgacggcgaguuccggcuccgcggggagcagcggaagaccuucguggagcugaugcgccggggcgaccugcccguguggcucagcuacaaggucgccuccgcggggaucagcuacaaggaccgcgaguggugcuucaccggcgagcggaacaaccagauccuggaggagaacauggagguggagaucuggacccgcgagggggagaagaagaagcugcggccccgcuggcucgacgcccggguguacgccgaccccauggcccugaaggacuucaaggaguucgccuccggccgcaagagccugacgcucgacauccugaccgagaucgcgucccugccgaccuaccucagcagccgcgccaagcuggcccuggacaacaucgucaugcuccacaccaccgagcggggcgggcgcgccuaccagcacgcgcugaacgagcugcccgagucccucgagacgcugaugcugguggcccuccugggcgccaugaccgccgggaucuuccuguucuucaugcagggcaaggggaucggcaagcucagcaugggccugaucaccaucgccguggcguccgggcugcucugggucgccgagauccagccccaguggaucgccgccagcaucauccuggaguucuuccugauggugcuccugaucccggagcccgagaagcagcggacgccccaggacaaccagcugaucuacgugauccucacgauccugaccaucaucggccugaucgccgcgaacgagauggggcucaucgagaagaccaagaccgacuucggcuucuaccaggucaagacggagaccaccauccuggacguggaccugcgccccgccuccgccuggacccucuacgccguggccacgaccauccugaccccgaugcugcggcacaccaucgagaacacgagcgcgaaccucucccuggccgccaucgccaaccaggccgcgguccugauggggcucggcaagggcuggccccugcaccgcauggaccugggggugccccuccuggccaugggcugcuacagccaggugaaccccaccacccugaccgccucccucgucaugcugcuggugcacuacgccaucaucgggccgggccuccaggcgaaggccacgcgggaggcccagaagcgcaccgccgccggcaucaugaagaaccccaccguggacgggaucaccgucaucgaccuggagcccaucagcuacgaccccaaguucgagaagcagcugggccaggugaugcuccuggugcugugcgcggggcagcuccugcugaugcggacgaccugggccuucugcgagguccucacccuggccaccggcccgauccugacgcucugggaggggaaccccggccgcuucuggaacaccaccaucgccguguccaccgccaacaucuuccggggcagcuaccuggcgggggccggccuggccuucucccucaucaagaacgcccagacgccccgccgggggaccggcaccaccggggagacgcugggcgagaaguggaagcgccagcugaacagccucgaccggaaggaguucgaggaguacaagcgcuccggcauccuggagguggaccggaccgaggccaagagcgcgcugaaggacggguccaagaucaagcacgccgucagccgcggcuccagcaagauccgguggaucguggagcgcgggauggugaagcccaagggcaaggucguggaccucgggugcggccgcggcggguggagcuacuacauggccacccugaagaacgugaccgaggucaagggcuacaccaagggcggcccggggcacgaggagcccauccccauggccacguacggcuggaaccuggugaagcuccacuccggcguggacgucuucuacaagcccaccgagcaggucgacacccugcugugcgacaucggggagagcuccagcaacccgaccaucgaggagggccggacgcuccgcgugcugaagauggucgagcccuggcuguccagcaagcccgaguucugcaucaaggugcugaaccccuacaugccgaccgugaucgaggagcucgagaagcugcagcggaagcacgggggcaaccugguccgcugcccccucucccggaacagcacccacgagauguacuggguguccggcgcgagcgggaacaucguguccagcgucaacaccacguccaagaugcugcugaaccgcuucaccacccggcaccgcaagcccaccuacgagaaggacguggaccucggcgccgggacgcggagcgucuccaccgagaccgagaagcccgacaugaccaucaucggccgccggcugcagcgccugcaggaggagcacaaggagacguggcacuacgaccaggagaacccguaccggaccugggccuaccacgggagcuacgaggcccccuccaccggcagcgccuccagcauggugaacggcguggucaagcuccugaccaagcccugggacgugaucccgauggugacgcagcuggcgaugaccgacaccacccccuucgggcagcagcgcgucuucaaggagaagguggacacgcggacgccccagcccaagccgggcacccgcauggugaugaccacgaccgccaacuggcucugggcccugcuggggaagaagaagaacccccggcucugcaccaaggaggaguucaucagcaagguccgcgccaacgccgcgaucggcgccguguuccaggaggagcagggguggaccuccgccagcgaggccgugaacgacucccgguucugggagcuggucgacaaggagcgcgcccugcaccaggagggcaagugcgagagcugcguguacaacaugaugggcaagcgggagaagaagcucggggaguucggccgcgcgaaggggucccgcgccaucugguacauguggcugggcgcccgguuccuggaguucgaggcccucggguuccugaacgaggaccacugguucggccgcgagaacagcugguccggcguggagggggagggccugcaccggcucggguacauccuggaggagaucgacaagaaggacggcgaccugauguacgcggacgacacggccggcugggacacccgcaucaccgaggacgaccuccagaacgaggagcugaucaccgagcagauggcgccccaccacaagauccuggccaaggccaucuucaagcucacguaccagaacaaggucgugaaggugcugcggcccaccccgcgcggggcggucauggacaucaucagccggaaggaccagcgcggcuccggccaggugggcaccuacgggcugaacaccuucaccaacauggaggugcagcucauccggcagauggaggccgagggcgucaucacgcaggacgacaugcagaaccccaagggccugaaggagcgcguggagaaguggcugcgggagugcgggguggaccgccucaagcggauggccaucagcggcgacgacugcgucgugaagccccuggacgagcgcuucgccaccucccuccuguuccugaacgacauggggaaggugcggaaggacaucccccagugggagccgagcaagggcuggaagaacuggcaggagguccccuucugcucccaccacuuccacaagaucuucaugaaggacgggcgcagccugguggugcccugccggaaccaggacgagcucaucggccgcgcccggaucucccagggcgcgggguggagccugaaggagaccgccugccuggccaaggccuacgcccagauguggucccucauguacuuccaccgccgcgaccugcggcuggcgagcauggccaucugcagcgccguccccaccgagugguucccgacgucccgcaccaccuggagcauccacgcccaccaccaguggaugaccacggaggacaugcucaagguguggaaccggguguggaucgaggacaaccccaacaugaucgacaagacccccguccacuccugggaggacauccccuaccugggcaagcgcgaggaccuguggugcgggagccucaucggccuguccagccgggccaccugggcgaagaacauccacaccgccaucacccaggugcgcaaccugaucgggaaggaggaguacauggacuacaugccggugaugcggcgcuacuccgcccccagcgaguccgagggcguccucuga

SEQ ID NO: 10533 - RNA, 9867 nt, Artificial Sequence
  derived and/or modified CDS sequence (opt1) from DENV-4__KU523871__SS-prME
agcaccaugacccugcucugccugauccccaccgugauggccuuccaccuguccacccgcgacggcgagccgcucaugaucguggccaagcacgagcgggggcgcccccugcuguucaagaccaccgagggcaucaacaagugcacccucaucgcgauggaccugggggagaugugcgaggacaccgugaccuacaagugcccccugcucgugaacaccgagcccgaggacaucgacugcuggugcaaccugaccagcaccugggucauguacgggaccugcacccagaacggggagcggcgccgggagaagcgcuccguggcccugaccccgcacagcggcaugggccucgagacccgggccgagaccuggauguccagcgagggggccuggaagcacgcccagcgcguggaguccuggauccugcggaaccccggcuucgcgcugcucgccggguucauggccuacaugaucggccagaccgggauccagcgcaucgucuucuucgugcugaugaugcugguggcccccagcuacggcaugcggugcgucggcguggggaaccgcgacuucguggagggcgucuccgggggcgcguggguggaccucgugcuggagcacggcgggugcgucaccaccauggcccagggcaagcccacccuggacuucgagcucaccaagacgaccgccaaggagguggcccugcugcggaccuacugcaucgaggccagcaucuccaacaucaccacggcgacccgcugcccgacccagggggagcccuaccucaaggaggagcaggaccagcaguacaucugccggcgcgacguggucgaccggggcugggggaacggcugcggccuguucgggaagggcgggguggugaccugcgccaaguucagcugcuccggcaagaucacggggaaccugguccagaucgagaaccucgaguacaccgugguggucaccgugcacaacggcgacacccacgccgucggcaacgacacgagcaaccacggggugaccgccaccaucacgccccgcucccccagcguggaggucaagcugccggacuacggcgagcugacgcucgacugcgagccccgguccgggaucgacuucaacgagaugauccugaugaagaugaagaagaagaccuggcuggugcacaagcagugguuccucgaccugccccugcccuggaccgccggcgcggacaccagcgaggugcacuggaaccacaaggagcgcauggucaccuucaaggugccgcacgccaagcggcaggacgugacgguccucgggucccaggagggcgccaugcacagcgcccuggccggcgcgaccgagguggacagcggggacggcaaccacauguucgccgggcaccugaagugcaaggugcgcauggagaagcuccgcaucaagggcauguccuacaccaugugcagcggcaaguucuccaucgacaaggagauggccgagacccagcacgggacgaccgucgugaaggugaaguacgagggcgccggggcccccugcaagguccccaucgagauccgggacgugaacaaggagaagguggucggccgcaucaucagcuccacccccuucgcggagaacaccaacagcgugacgaacaucgagcuggagccgcccuucggggacuccuacaucgugaucggcgucggcgagagcgcccugacccuccacugguuccggaagggguccagcaucggcaagauguucgaguccaccuaccgcggggccaagcggauggccauccugggcgagaccgcgugggacuucgggagcgugggcggccuguucacgucccucgggaaggccgugcaccaggucuucggcagcguguacaccaccauguucgggggcguguccuggaugguccgcauccugaucggguuccuggugcucuggaucggcaccaacagccggaacacguccauggccaugaccugcaucgccgugggcgggaucacccuguuccugggcuucaccguccaggccgacauggggugcguggugagcugguccggcaaggagcugaagugcgggagcggcaucuucgucguggacaacgugcacacguggaccgagcaguacaaguuccagcccgagagccccgcgcgccucgccuccgccauccugaacgcccacaaggacggcgucugcgggauccggagcaccacccgccuggagaacgugauguggaagcagaucacgaacgagcucaacuacgugcugugggagggcgggcacgaccugaccgucguggccggcgacgugaagggcguccucacccgggggaagcgcgcgcugaccccgcccgugaacgaccugaaguacuccuggaagacguggggcaaggccaagaucuucacccccgaggcccggaacagcaccuuccucaucgacgggcccgacaccuccgagugcccgaacgagcgccgggccuggaacuucuucgagguggaggacuacggcuucgggauguucacgaccaacaucuggaugaaguuccgcgagggcagcuccgaggucugcgaccaccggcugaugagcgccgcgaucaaggaccagaaggccgugcacgccgacaugggcuacuggaucgaguccagcaagaaccagaccuggcagaucgagaaggccucccugaucgaggugaagaccugccucuggcccaagacgcacacccuguggagcaacgggguccuggagucccagaugcucaucccccgcagcuacgcgggcccguucucccagcacaacuaccggcagggguacgccacccagaccgugggccccuggcaccuggggaagcuggagaucgacuucggcgagugccccggcaccacgguggccauccgcgaggacugcgaccaccgcgggcccagccuccggaccaccaccgccuccggcaagcuggucacgcaguggugcugccgcagcugcaccaugccgccccugcgguuccucggggaggacggcugcugguacgggauggagauccgcccccugagcgagaaggaggagaacauggugaagucccaggccaccgcgggccagggcaccagcgagacguucuccauggggcugcucugccugacccuguucgucgaggagugccuccggcgccgggugacccgcaagcacaugauccugguggucgugaucaccuucugcgccaucauccugggcgggcucacguggauggaccugcugcgggcccucaucaugcugggcgacaccaugagcggccgcaucgggggccagauccaccuggccaucauggccguguucaagaugucccccggguacguccucggcguguuccugcggaagcugaccagccgcgagaccgcgcucauggugaucgggauggccaugacgaccgucuucuccaucccgcacgaccugauggagcugaucgacggcaucagccucggccugauccugcucaagaucgugacccacuucgacaacacccagguggggacgcuggcccugucccucaccuuccugcggagcaccacgccccuggucauggccuggcgcacgaucauggccguguucuucguggucacccucaucccccugugccggaccuccugccugcagaagcagagccacuggguggagaucaccgcgcucauccugggcgcccaggcccugcccguguaccucaugacgcugaugaagggggccucccgccggagcuggccgcugaacgagggcaucauggcggucgggcucgugucccugcugggcagcgcccuccugaagaacgacgugccccuggccggccccauggucgccgggggccuccugcuggccgcguacgugauguccgggagcuccgccgaccucagccuggagaaggccgccaacgugcagugggacgagauggccgacaucaccggcagcucccccaucaucgaggucaagcaggacgaggacgggagcuucuccauccgcgacguggaggagaccaacaugaugacccugcucgugaagcuggcgcugaucacggucagcggccucuacccgcuggccauccccgugaccauggcccugugguacaucuggcaggucaagacccagcgguccggcgcccucugggacguccccagccccgccgcgacccagaaggccacgcuguccgaggggguguaccgcaucaugcagcggggccuguucgggaagacccaggugggcgucgggauccacauggagggcguguuccacaccauguggcacgugacccgcggcagcgucaucugccacgagaccgggcgccucgagccguccugggccgacgugcggaacgacaugaucagcuacggcgggggcuggcgccugggcgacaagugggacaaggaggaggacgugcagguccuggccaucgagcccgggaagaaccccaagcacgugcagacgaagcccggccucuucaagacccugaccggggagaucggcgccgugacccuggacuucaagccggggacguccggcagccccaucaucaacaagaagggcaaggucaucgggcucuacggcaacgggguggugaccaaguccggcgacuacgucagcgcgaucacccaggccgagcggaucggggagcccgacuacgagguggacgaggacaucuuccgcaagaagcggcugaccaucauggaccugcacccgggcgccggcaagacgaagcgcauccuccccuccaucgugcgggaggcccugaagcgccggcugcgcacccucauccuggcgcccacccgggucguggccgccgagauggaggaggcccugcgcgggcugcccauccgguaccagaccccggccgugaaguccgagcacacgggccgcgagaucgucgaccucaugugccacgcgaccuucaccacccggcugcuguccagcacgcgcgugcccaacuacaaccucaucgucauggacgaggcccacuucaccgaccccugcuccguggccgcccggggguacaucagcacccgcguggagaugggcgaggccgcggccaucuucaugaccgccacgcccccgggggccaccgaccccuucccccagagcaacucccccaucgaggacaucgagcgggagaucccggagcgcagcuggaacaccggcuucgacuggaucaccgacuaccagggcaagacggucugguucgugcccuccaucaaggccgggaacgacaucgcgaacugccugcgcaagagcggcaagcgggugauccagcugucccgcaagaccuucgacaccgaguaccccaagaccaagcucacggacugggacuucgucgugaccaccgacaucagcgagaugggggccaacuuccgggccggccgcgugaucgacccccggcgcugccugaagccggucauccugaccgacgggcccgagcgggugauccucgccggccccauccccgugacgccggcguccgccgcccagcgccggggccgcaucgggcggaaccccgcccaggaggacgaccaguacgucuucagcggcgacccccugaagaacgacgaggaccacgcccacuggaccgaggcgaagaugcugcucgacaacaucuacacccccgaggggaucaucccgacccuguucggccccgagcgcgagaagacgcaggccaucgacggcgaguuccggcugcgcggggagcagcggaagaccuucguggagcucaugaagcgcggcgaccugcccguguggcuguccuacaaggucgccagcgccgggaucuccuacaaggaccgggaguggugcuucaccggcgagcgcaacaaccagauccucgaggagaacauggagguggagaucuggaccaaggagggggagaagaagaagcugcggcccaaguggcuggacgcccgcguguacgcggacccgauggcccucaaggacuucaaggaguucgccagcggccggaaguccaucacgcuggacauccugaccgagaucgccagccuccccaccuaccuguccagcaaggccaagcuggcgcucgacaacaucaucaugcugcacaccaccgagaagggcgggcgcgccuaccagcacgcccugaacgagcuccccgagucccuggagacgcugaugcucgucgcccugcugggcgcgaugaccgccgggaucuuccucuucuucaugcagggcaaggggaucggcaagcugagcaugggccugaucgccaucgccguggccuccgggcuccuguggguggcggagauccagccgcaguggaucgccgccagcaucauccuggaguucuuccucaugguccugcugauccccgagcccgagaagcagcgcacgccccaggacaaccagcucaucuacgugauccugaccauccugacgaucaucggccucaucgccgccaacgagauggggcugaucgagaagaccaagaccgacuucggcuucuaccaggugaagaccgagacgaccauccuggacgucgaccuccggccggcgagcgccuggacccuguacgccguggccaccacgauccugacccccaugcuccgccacaccaucgagaacaccuccgccaaccugagccuggcggccaucgccaaccaggccgccgugcucauggggcugggcaagggcuggccccugcaccggauggaccucggggucccccugcuggcgaucggcugcuacucccaggugaacccgacgacccucaccgccagccuggugaugcugcucguccacuacgccaucaucgggcccggccugcaggccaaggcgacccgcgaggcccagaagcggacggccgccggcaucaugaagaaccccaccguggacgggaucaccgugaucgaccuggagcccaucuccuacgacccgaaguucgagaagcagcucggccaggucaugcugcuggugcucugcgccgggcagcugcugcucaugcgcaccacgugggcgcugugcgaggugcugacccucgccaccggccccgccaugacccugugggaggggaaccccggccgguucuggaacacgaccaucgccgucagcaccgccaacaucuuccgcggcuccuaccuggcgggggccggccucgccuucagccugaucaagaacgcccagacgccccggcgcgggacgggcaccaccggggagacccugggcgagaaguggaagcggcagcucaacucccuggaccgcaaggaguucgaggaguacaagcggagcggcauccuggagguggaccgcacggaggccaaguccgcgcucaaggacgggagcaagaucaagcacgccgugucccggggcagcuccaagauccgcuggaucgucgagcgggggauggugaagccgaagggcaagguggucgaccuggggugcggccgcggcggguggagcuacuacauggccacccugaagaacgugaccgaggugaagggcuacaccaagggcggccccgggcacgaggagcccauccccauggccaccuacggcuggaaccucgucaagcugcacuccggcguggacguguucuacaagccgacggagcaggucgacacccugcucugcgacaucggggagagcuccagcaaccccaccaucgaggagggccggacccugcgcgugcugaagaugguggagcccuggcucagcuccaagcccgaguucugcaucaagguccugaacccguacaugcccacggugaucgaggagcuggagaagcuccagcgccggcacgggggcagccugguccgcugcccccugucccggaacagcacccacgagauguacuggguguccggcgcgagcgggaacaucguguccagcgucaacaccaucuccaagaugcugcucaaccgcuucaccacgcggcaccgcaagcccaccuacgagaaggacguggaccugggcgccgggacccggagcguguccaccgagacggagaagccggacaugaccaucaucggccgccggcugcagcgccuccgggaggagcacaaggagaccuggcacuacgaccaggagaaccccuaccgcaccugggccuaccacgggagcuacgaggcccccuccacgggcagcgccuccagcauggucaacggcguggugaagcugcugaccaagccgugggacgucgugcccauggugacccagcucgcgaugaccgacacgacccccuucgggcagcagcgggucuucaaggagaagguggacacccgcacgccccagccgaagcccggcacgcggaugaucaugaccaccaccgccaacuggcuguggacgcugcucgggaagaagaaguccccgcgccugugcacccgggaggaguucaucagcaaggugcgcagcaacgccgccaucggcgccgucuuccaggaggagcagggguggaccagcgcgagcgaggccgugaacgacucccgguucugggagcugguggacaaggagcgcgcccuccaccaggagggcaagugcgagagcugcgucuacaacaugaugggcaagcgggagaagaagcugggggaguucggccgcgccaaggggucccgcgccaugugguacauguggcugggcgcgcgguuccucgaguucgaggcccugggguuccugaacgaggaccacugguucagccgcgagaacuccuggagcggcguggagggcgaggggcuccaccggcugggcuacauccuggaggacaucgacaagaaggacggggaccucaucuacgccgacgacaccgccggcugggacacgcgcaucaccgaggacgaccugcugaacgaggagcucaucaccgagcagauggcgccccaccacaagacccuggccaaggccaucuucaagcugacguaccagaacaagguggucaaggugcuccggcccacccccaagggcgccgugauggacaucaucucccgcaaggaccagcgggggagcggccaggucgggaccuacggccugaacaccuucaccaacauggaggugcagcugauccgccagauggaggccgagggggugaucacgcaggacgacaugcagaaccccaagggccucaaggagcgggucgagaaguggcugaccgagugcggcguggaccgccugaagcggauggcgaucuccggggacgacugcguggucaagccccucgacgagcgcuucagcaccucccugcuguuccucaacgacaugggcaaggugcggaaggacaucccgcagugggagcccagcaagggguggaagaacuggcaggaggugcccuucugcucccaccacuuccacaagaucuucaugaaggacggccgcagccuggucgugcccugccggaaccaggacgagcugaucgggcgcgcccggaucucccagggcgccggcuggagccuccgcgagaccgccugccuggggaaggccuacgcgcagauguggucccugauguacuuccaccggcgcgaccuccgccuggccagcauggccaucugcagcgccgugccgacggagugguuccccaccucccggaccaccuggagcauccacgcccaccaccaguggaugacgaccgaggacaugcugaaggucuggaaccgcguguggaucgaggacaaccccaacaugaccgacaagacccccguguacuccugggaggacaucccguaccucggcaagcgggaggaccuguggugcgggagccugaucggccucuccagccgcgcgacgugggccaagaacauccacaccgccaucacccagguccggaaccugaucgggaaggaggacuacguggacuacaugcccaucaugaagcgcuacuccgcccccagcgaguccgagggcgugcuguga

SEQ ID NO: 10534 - RNA, 9867 nt, Artificial Sequence
  derived and/or modified CDS sequence (opt1) from DENV-4__HQ332175__SS-prME
agcaccaucacccugcucugccugauccccacggugauggccuuccaccuguccacccgcgacggcgagccgcucaugaucgucgccaagcacgagcgggggcgcccccugcuguucaagaccaccgagggcaucaacaagugcacgcucaucgcgauggaccugggggagaugugcgaggacaccgugaccuacaagugcccccugcucgugaacaccgagcccgaggacaucgacugcuggugcaaccugacgagcaccugggucauguacggcaccugcacccaguccggggagcggcgccgggagaagcgcagcguggcccugacgccgcacuccggcaugggccucgagacccgggccgagaccuggaugagcuccgagggggccuggaagcacgcccagcgcguggagagcuggauccugcggaaccccggcuucgcgcugcucgccggguucauggccuacaugaucggccagaccgggauccagcgcacggucuucuucgugcugaugaugcugguggcccccuccuacggcaugcggugcgucggcguggggaaccgcgacuucguggagggcgucagcgggggcgcguggguggaccucgugcuggagcacggcgggugcgucaccaccauggcccagggcaagcccacccuggacuucgagcucacgaagaccaccgccaaggagguggcccugcugcggaccuacugcaucgaggcccucaucuccaacaucacgaccgcgacccgcugcccgacccagggggagcccuaccugaaggaggagcaggaccagcaguacaucugccggcgcgacguggucgaccggggcugggggaacggcugcggccuguucgggaagggcgggguggugacgugcgccaaguucagcugcuccggcaagaucaccgggaaccucguccagaucgagaaccuggaguacaccgugguggucaccgugcacaacggcgacacgcacgccgucggcaacgacaccagcaaccacggggugaccgccaccaucacgccccgcucccccagcguggaggucaagcugccggacuacggcgagcucacccuggacugcgagccccgguccgggaucgacuucaacgagaugauccugaugaagaugaagaagaagaccuggcucgugcacaagcagugguuccuggaccugccccuccccuggaccaccggcgccgacacgagcgaggugcacuggaacuacaaggagcgcauggucaccuucaaggugccgcacgcgaagcggcaggacgugaccguccuggggucccaggagggcgccaugcacagcgcccuggccggcgccaccgagguggacagcggggacggcaaccacauguucgcggggcaccucaagugcaaggugcgcauggagaagcugcgcaucaagggcauguccuacacgaugugcagcggcaaguucuccaucgacaaggagauggccgagacccagcacgggaccaccgucgugaaggugaaguacgagggcgccggggcccccugcaagguccccaucgagauccgggacgugaacaaggagaagguggucggccgcgugaucagcgccacgccccuggcggagaacaccaacuccgugaccaacaucgagcucgagccgcccuucggggacagcuacaucgucaucggcgugggcaacuccgcccugacccugcacugguuccggaaggggagcuccaucggcaagauguucgagagcacguaccgcggggccaagcggauggccauccucggcgagaccgcgugggacuucggguccgugggcggccuguucaccagccuggggaaggccguccaccagguguucggcuccguguacaccacgauguucgggggcgucagcuggaugauccgcauccucaucggguuccuggugcuguggaucggcaccaacucccggaacaccagcauggccaugaccugcaucgccgugggcgggaucacgcuguuccucggcuucaccguccaggccgacauggggugcgugguguccuggagcggccgcgagcugaagugcggguccggcaucuucgucguggacaacgugcacaccuggaccgagcaguacaaguuccagcccgagagccccgcgcggcuggccagcgccauccucaacgcccacaaggacggcgucugcgggauccgcuccacgacccggcuggagaacgugauguggaagcagaucaccaacgagcugaacuacgugcucugggagggcgggcacgaccugaccgucguggccggcgacgugaagggcguccugacgaaggggaagcgcgcgcucaccccgcccgccagcgaccugaaguacuccuggaagaccuggggcaaggccaagaucuucacccccgaggcccggaacagcacguuccugaucgacgggcccgacaccuccgagugcccgaacgagcgccgggccuggaacagcuucgagguggaggacuacggcuucgggauguucaccaccaacaucuggaugaaguuccgcgagggcuccagcgaggugugcgaccaccggcucauguccgcggccaucaaggaccagaaggccguccacgccgacaugggcuacuggaucgagagcuccaagaaccagacguggcagaucgagcgcgcgagccugaucgaggugaagaccugccuguggcccaagacccacacccucugguccaacggggugcuggagagccagaugcugauccccaaguccuacgccggcccguucagccagcacaacuaccggcagggguacgccacccagacggucggccccuggcaccucgggaagcuggagaucgacuucggcgagugccccggcaccaccgugaccauccaggagaacugcgaccaccgcgggcccucccugcgcacgaccaccgccagcggcaagcucgugacccaguggugcugccggagcugcacgaugccgccccugcgcuuccugggggaggacggcugcugguacgggauggagauccggccccucuccgagaaggaggagaacauggucaagagccaggugaccgccggccagggcaccuccgagaccuucagcauggggcugcugugccucacgcuguucgucgaggagugccugcgccggcgcgugacccggaagcacaugauccucgcgguggucaucacccugugcgccaucauccugggcgggcucaccuggauggaccugcugcgcgcccucaucaugcugggcgacacgauguccggccggaucgggggccagacccaccuggccaucauggccguguucaagaugagccccggguacgugcucggcgucuuccugcgcaagcugaccucccgggagaccgcgcucauggugaucgggauggccaugacgaccacccugagcaucccgcacgaccugauggagcucaucgacggcaucucccugggccugauccuccugaagaucgugacccaguucgacaacacgcaggucgggacccuggcccucagccugaccuucauccgcuccaccaugagccuggugauggccuggcggacgaucauggccgugcucuucgucgugacccugaucccccugugccgcaccuccugccuccagaagcagagccacuggguggagaucaccgcgcugauccugggcgcccaggcccuccccgucuaccugaugacgcugaugaagggggccucccggcgcagcuggccccucaacgagggcaucauggcgguggggcuggugucccugcucggcagcgcccugcugaagaacgacgucccgcucgccggccccaugguggccgggggccugcugcucgccgcguacgugauguccgggagcagcgucgaccugucccuggagaaggccgccaacgugcagugggacgagauggccgacaucaccggcagcucccccaucaucgaggugaagcaggacgaggacgggagcuucuccauccgggacgucgaggagaccaacaugaucacccuccuggugaagcuggcccucaucacggugagcggccuguacccccuggcgaucccgaucaccaugacccucugguacauguggcaggucaagacccagcgcuccggcgcccugugggacgugcccagccccgccgccacccagaaggccgcgcuguccgaggggguguaccggaucaugcagcgcggccucuucgggaagacgcaggucggcguggggauccacauggagggcguguuccacaccauguggcacgucacccggggcagcgugaucugccacgagaccgggcgccuggagcccuccugggccgacgugcgcaacgacaugaucagcuacggcgggggcuggcggcugggcgacaagugggacaaggaggaggacguccaggugcucgccaucgagccggggaagaaccccaagcacgugcagacgaagcccggccuguucaagacccugaccggggagaucggcgccgucacccucgacuucaagcccgggacguccggcagcccgaucaucaaccgcaagggcaaggugaucgggcuguacggcaacgggguggucaccaaguccggcgacuacgugagcgccaucacccaggcggagcggaucggggagcccgacuacgagguggacgaggacaucuuccgcaagaagcggcugaccaucauggaccuccaccccggcgccggcaagacgaagcgcauccugccguccaucguccgggaggcccugaagcgccggcugcgcacccucauccuggcccccacccgggugguggcggccgagauggaggaggcccugcgcgggcuccccauccgguaccagacccccgccgucaagagcgagcacacgggccgcgagaucguggaccugaugugccacgccaccuucaccacccggcugcucuccagcacgcgcgugccgaacuacaaccugaucgucauggacgaggcgcacuucaccgaccccagcuccguggccgcccggggguacaucagcacccgcgucgagaugggcgaggccgccgcgaucuucaugaccgccacgccccccggggccaccgacccguucccccaguccaacagccccaucgaggacaucgagcgggagauccccgagcgcuccuggaacaccggcuucgacuggaucaccgacuaccagggcaagacggugugguucgugccgagcaucaaggccgggaacgacaucgccaacugccugcgcaaguccggcaagaaggucauccagcucagccggaagaccuucgacaccgaguaccccaagaccaagcugacggacugggacuucguggugaccaccgacaucuccgagaugggggcgaacuuccgcgccggccgggucaucgacccccgccggugccugaagcccgugauccucaccgacgggccggagcgcgugauccuggccggccccauccccgucacgcccgccagcgcggcccagcggcgcggccggaucgggcgcaacccggcccaggaggacgaccaguacguguucuccggcgacccccugaagaacgacgaggaccacgcccacuggaccgaggccaagaugcuccuggacaacaucuacacccccgaggggaucauccccacccuguucggcccggagcgggagaagacgcaggcgaucgacggcgaguuccgccuccggggggagcagcgcaagaccuucguggagcugaugcggcgcggcgaccugcccgucuggcucagcuacaagguggccuccgccgggaucagcuacaaggaccgggaguggugcuucaccggcgagcgcaacaaccagauccuggaggagaacauggagguggagaucuggacccgggagggggagaagaagaagcugcgccccaaguggcucgacgcccgggucuacgccgaccccauggcgcugaaggacuucaaggaguucgccuccggccgcaagagcaucacccuggacauccucacggagaucgccucccugccgaccuaccugagcucccgcgccaagcucgcccuggacaacaucgugaugcugcacaccaccgagcggggcgggcgcgcguaccagcacgcccucaacgagcugcccgagagccuggagacgcucaugcugguggcccugcucggcgccaugaccgcggggaucuuccuguucuucaugcagggcaaggggaucggcaagcugagcaugggccucaucaccaucgccgucgccuccgggcugcuguggguggccgagauccagccccaguggaucgccgcgagcaucauccucgaguucuuccugauggugcugcucaucccggagcccgagaagcagcggaccccccaggacaaccagcugaucuacgucauccugacgauccucaccaucaucggccugaucgccgccaacgagauggggcugaucgagaagaccaagaccgacuucggcuucuaccaggugaagacggagaccaccauccucgacguggaccugcgccccgccuccgccuggacccuguacgcggucgccacgaccauccucaccccgaugcugcggcacaccaucgagaacacgagcgccaaccugucccucgccgccaucgcgaaccaggccgccgugcugauggggcugggcaagggcuggccccuccaccgcauggaccugggggugccccugcucgccaugggcugcuacagccaggucaaccccaccacccugaccgccucccuggugaugcuccuggugcacuacgcgaucaucgggccgggccugcaggccaaggccacgcgggaggcccagaagcgcaccgcggccggcaucaugaagaaccccaccgucgacgggaucaccgugaucgaccucgagcccaucagcuacgaccccaaguucgagaagcagcugggccaggugaugcugcucguccugugcgccgggcagcugcuccugaugcggacgaccugggccuucugcgaggugcugacccucgccaccggcccgauccugacgcugugggaggggaaccccggccgcuucuggaacaccaccaucgcgguguccaccgccaacaucuuccggggcagcuaccucgccggggccggccuggccuucucccugaucaagaacgcgcagacgccccgccgggggaccggcaccaccggggagacccucggcgagaaguggaagcgccagcugaacagccuggaccggaaggaguucgaggaguacaagcgcuccggcauccucgaggucgaccggacggaggccaagagcgcccugaaggacggguccaagaucaagcacgccgugagccgcggcuccagcaagauccgguggaucguggagcgcgggauggucaagcccaagggcaaggugguggaccuggggugcggccgcggcgggugguccuacuacauggccacccucaagaacgucaccgaggugaagggcuacaccaaggggggcccggggcacgaggagcccauccccauggcgacguacggcuggaaccuggugaagcugcacagcggcgucgacguguucuacaagcccaccgagcagguggacacccuccugugcgacaucggggagagcuccagcaacccgaccaucgaggagggccggacgcugcgcguccucaagaugguggagcccuggcuguccagcaagcccgaguucugcaucaaggugcugaaccccuacaugccgaccgucaucgaggagcuggagaagcuccagcggaagcacgggggcaaccuggugcgcugcccccugucccggaacagcacccacgagauguacugggucuccggcgccagcgggaacaucguguccagcgugaacaccacguccaagaugcuccugaaccgcuucaccacccggcaccgcaagcccaccuacgagaaggacgucgaccugggcgccgggacgcggagcguguccaccgagaccgagaagcccgacaugaccaucaucggccgccggcuccagcgccugcaggaggagcacaaggagacguggcacuacgaccaggagaacccguaccggaccugggccuaccacgggagcuacgaggcgcccuccaccggcagcgccuccagcauggugaacggcgucgugaagcugcucaccaagcccugggacgugaucccgauggucacgcagcuggccaugaccgacaccacccccuucgggcagcagcgcguguucaaggagaagguggacacgcggaccccccagcccaagccgggcacccgcauggucaugaccacgaccgccaacuggcugugggcccuccuggggaagaagaagaacccccggcugugcacccgcgaggaguucaucuccaaggugcggagcaacgcggccaucggcgccguguuccaggaggagcagggguggaccagcgccuccgaggccgucaacgacagccgcuucugggagcucguggacaaggagcgggcgcugcaccaggagggcaagugcgaguccugcguguacaacaugaugggcaagcgcgagaagaagcugggggaguucggccgcgccaaggggagccgggccaucugguacauguggcucggcgcccgcuuccuggaguucgaggcccugggguuccucaacgaggaccacugguucggccgggagaacuccuggagcggcgucgagggggagggccugcaccgccugggguacauccucgaggagaucgacaagaaggacggcgaccugauguacgcggacgacacggccggcugggacacccggaucaccgaggacgaccugcagaacgaggagcucaucaccgagcagauggccccccaccacaagauccuggccaaggcgaucuucaagcugaccuaccagaacaagguggugaagguccuccgccccacgccgcggggggccgugauggacaucaucucccgcaaggaccagcggggcagcgggcaggugggcaccuacgggcugaacaccuucaccaacauggagguccagcugauccgccagauggaggccgagggcgugaucacgcaggacgacaugcagaaccccaagggccucaaggagcggguggagaaguggcugcgcgagugcggggucgaccggcugaagcgcauggccaucuccggcgacgacugcguggugaagccccucgacgagcgguucgggaccagccugcuguuccucaacgacaugggcaagguccgcaaggacaucccccagugggagccguccaagggguggaagaacuggcaggaggugcccuucugcagccaccacuuccacaagaucuucaugaaggacggccggucccuggugguccccugccgcaaccaggacgagcugaucggccgggcccgcaucagccagggggcgggcuggucccuccgcgagaccgccugccuggggaaggccuacgcccagauguggagccugauguacuuccaccggcgcgaccuccggcuggccuccauggcgaucugcagcgccgugcccaccgagugguucccgacgagccgcaccaccugguccauccacgcccaccaccaguggaugaccacggaggacaugcugaagguguggaaccgggucuggaucgaggacaaccccaacaugaucgacaagacccccgugcacagcugggaggacauccccuaccucggcaagcgcgaggaccuguggugcgggucccugaucggccucagcucccgggccaccugggccaagaacauccacaccgcgaucgcccaggugcgcaaccugaucggcaaggaggaguacgucgacuacaugccggugaugaagcgguacagcgcccccuccgagagcgagggggugcuguga

SEQ ID NO: 10535 - RNA, 9867 nt, Artificial Sequence
  derived and/or modified CDS sequence (opt1) from DENV-4__HQ332172__SS-prME
agcaccaucacccugcucugccugauccccacggugauggccuuccaccuguccacccgcgacggcgagccgcucaugaucgucgccaagcacgagcgggggcgcccccugcuguucaagaccaccgagggcaucaacaagugcacgcucaucgcgauggaccugggggagaugugcgaggacaccgugaccuacaagugcccccugcucgugaacaccgagcccgaggacaucgacugcuggugcaaccugacgagcgccugggucauguacggcaccugcacccaguccggggagcggcgccgggagaagcgcagcguggcccugaccccgcacuccggcaugggccucgagacgcgggccgagaccuggaugagcuccgagggggccuggaagcacgcgcagcgcguggagagcuggauccugcggaaccccggcuucgcccugcucgccggguucauggccuacaugaucggccagaccgggauccagcgcaccgucuucuucgugcugaugaugcugguggcgcccuccuacggcaugcggugcgucggcguggggaaccgcgacuucguggagggcgucagcgggggcgccuggguggaccucgugcuggagcacggcgggugcgucacgaccauggcccagggcaagcccacccuggacuucgagcucaccaagacgaccgccaaggagguggcccugcugcggaccuacugcaucgaggcgcucaucuccaacaucaccacggccacccgcugcccgacccagggggagcccuaccugaaggaggagcaggaccagcaguacaucugccggcgcgacguggucgaccggggcugggggaacggcugcggccuguucgggaagggcgggguggugaccugcgccaaguucagcugcuccggcaagaucacggggaaccucguccagaucgagaaccuggaguacaccgugguggucaccgugcacaacggcgacacccacgccgucggcaacgacacgagcaaccacggggugaccgccaccaucaccccccgcucccccagcguggaggucaagcugccggacuacggcgagcucacgcuggacugcgagccccgguccgggaucgacuucaacgagaugauccugaugaagaugaagaagaagaccuggcucgugcacaagcagugguuccuggaccugccccuccccuggaccaccggcgcggacaccagcgaggugcacuggaacuacaaggagcgcauggucacguucaaggugccgcacgccaagcggcaggacgugaccguccuggggucccaggagggcgccaugcacagcgcccuggccggcgcgaccgagguggacagcggggacggcaaccacauguucgccgggcaccucaagugcaaggugcgcauggagaagcugcgcaucaagggcauguccuacaccaugugcagcggcaaguucuccaucgacaaggagauggccgagacgcagcacgggaccaccgucgugaaggugaaguacgagggcgccggggcccccugcaagguccccaucgagauccgggacgugaacaaggagaagguggucggccgcgugaucagcgcgaccccccuggccgagaacacgaacuccgugaccaacaucgagcucgagccgcccuucggggacagcuacaucgucaucggcgugggcaacuccgcccugacccugcacugguuccggaaggggagcuccaucggcaagauguucgagagcaccuaccgcggggccaagcggauggcgauccucggcgagacggccugggacuucggguccgugggcggccuguucaccagccuggggaaggccguccaccagguguucggcuccguguacaccaccauguucgggggcgucagcuggaugauccgcauccucaucggguuccuggugcuguggaucggcacgaacucccggaacaccagcauggccaugaccugcaucgccgugggcgggaucacccuguuccucggcuucacgguccaggcggacauggggugcgugguguccuggagcggccgcgagcugaagugcggguccggcaucuucgucguggacaacgugcacaccuggaccgagcaguacaaguuccagcccgagagccccgcccggcuggccagcgccauccucaacgcccacaaggacggcgucugcgggauccgcuccaccacgcggcuggagaacgugauguggaagcagaucaccaacgagcugaacuacgugcucugggagggcgggcacgaccugaccgucguggcgggcgacgugaagggcguccugaccaaggggaagcgcgcccucacgccgcccgccagcgaccugaaguacuccuggaagaccuggggcaaggccaagaucuucacccccgaggcccggaacagcaccuuccugaucgacgggcccgacacguccgagugcccgaacgagcgccgggcguggaacagcuucgagguggaggacuacggcuucgggauguucaccaccaacaucuggaugaaguuccgcgagggcuccagcgaggugugcgaccaccggcucauguccgccgccaucaaggaccagaaggccguccacgcggacaugggcuacuggaucgagagcuccaagaaccagaccuggcagaucgagcgcgccagccugaucgaggugaagacgugccuguggcccaagacccacacccucugguccaacggggugcuggagagccagaugcugauccccaaguccuacgccggcccguucagccagcacaacuaccggcagggguacgccacccagaccgucggccccuggcaccucgggaagcuggagaucgacuucggcgagugccccggcacgaccgugaccauccaggagaacugcgaccaccgcgggcccucccugcgcaccacgaccgccagcggcaagcucgugacccaguggugcugccggagcugcaccaugccgccccugcgcuuccugggggaggacggcugcugguacgggauggagauccggccccucuccgagaaggaggagaacauggucaagagccaggugacggcgggccagggcaccuccgagaccuucagcauggggcugcugugccucacccuguucgucgaggagugccugcgccggcgcgugacgcggaagcacaugauccucgccguggucaucacccugugcgccaucauccugggcgggcucaccuggauggaccugcugcgcgcccucaucaugcugggcgacaccauguccggccggaucgggggccagacgcaccuggccaucauggcgguguucaagaugagccccggguacgugcucggcgucuuccugcgcaagcugaccucccgggagaccgcccucauggugaucgggauggccaugaccacgacccugagcaucccgcacgaccugauggagcucaucgacggcaucucccugggccugauccuccugaagaucgugacccaguucgacaacacccaggucgggacgcuggcccucagccugaccuucauccgcuccaccaugagccuggugauggccuggcggaccaucauggcggugcucuucgucgugacgcugaucccccugugccgcaccuccugccuccagaagcagagccacuggguggagaucaccgcccugauccugggcgcccaggcccuccccgucuaccugaugacccugaugaagggggcgucccggcgcagcuggccccucaacgagggcaucauggccguggggcuggugucccugcucggcagcgcccugcugaagaacgacgucccgcucgccggccccaugguggccgggggccugcugcucgcggccuacgugauguccgggagcagcgccgaccugucccuggagaaggccgccaacguccagugggacgagauggcggacaucacgggcagcucccccaucaucgaggugaagcaggacgaggacgggagcuucuccauccgggacguggaggagaccaacaugaucacccuccuggucaagcuggcccucaucaccgugagcggccuguacccccuggccaucccgaucacgaugacccucugguacauguggcaggugaagacccagcgcuccggcgcccugugggacguccccagccccaccgccacccagaaggcggcccuguccgaggggguguaccggaucaugcagcgcggccucuucgggaagacgcaggugggcgucgggauccacauggagggcguguuccacaccauguggcacgugacccggggcagcgucaucugccacgagaccgggcgccuggagcccuccugggccgacgugcgcaacgacaugaucagcuacggcgggggcuggcggcugggcgacaagugggacaaggaggaggacgugcagguccucgccaucgagccggggaagaaccccaagcacgugcagacgaagcccggccuguucaagacccugaccggggagaucggcgccgugacccucgacuucaagcccgggacguccggcagcccgaucaucaaccgcaagggcaaggucaucgggcuguacggcaacgggguggugaccaaguccggcgacuacgucagcgcgaucacccaggccgagcggaucggggagcccgacuacgagguggacgaggacaucuuccgcaagaagcggcugaccaucauggaccuccaccccggcgccggcaagacgaagcgcauccugccguccaucgugcgggaggcccugaagcgccggcugcgcacccucauccuggcgcccacccgggucguggccgccgagauggaggaggcccugcgcgggcuccccauccgguaccagacccccgccgugaagagcgagcacacgggccgcgagaucgucgaccugaugugccacgcgaccuucaccacccggcugcucuccagcacgcgcgugccgaacuacaaccugaucgugauggacgaggcccacuucaccgaccccagcuccgucgccgcccggggguacaucagcacccgcguggagaugggcgaggccgcggccaucuucaugaccgccacgccccccggggccaccgacccguucccccaguccaacagccccaucgaggacaucgagcgggagauccccgagcgcuccuggaacaccggcuucgacuggaucaccgacuaccagggcaagacggucugguucgugccgagcaucaaggccgggaacgacaucgcgaacugccugcgcaaguccggcaagaaggugauccagcucagccggaagaccuucgacaccgaguaccccaagaccaagcugacggacugggacuucgucgugaccaccgacaucuccgagaugggggccaacuuccgcgccggccgggugaucgacccccgccggugccugaagcccgucauccucaccgacgggccggagcgcgugauccuggccggccccauccccgugacgcccgcgagcgccgcccagcggcgcggccggaucgggcgcaacccggcccaggaggacgaccaguacgucuucuccggcgacccccugaagaacgacgaggaccacgcccacuggaccgaggcgaagaugcuccuggacaacaucuacacccccgaggggaucauccccacccuguucggcccggagcgggagaagacgcaggccaucgacggcgaguuccgccuccggggggagcagcgcaagaccuucguggagcugaugcggcgcggcgaccugcccguguggcucagcuacaaggucgccuccgccgggaucagcuacaaggaccgggaguggugcuucaccggcgagcgcaacaaccagauccuggaggagaacauggagguggagaucuggacccgggagggggagaagaagaagcugcgccccaaguggcucgacgcccggguguacgcggaccccauggcccugaaggacuucaaggaguucgccuccggccgcaagagcaucacccuggacauccucacggagaucgccucccugccgaccuaccugagcucccgcgccaagcucgcgcuggacaacaucgucaugcugcacaccaccgagcggggcgggcgcgccuaccagcacgcccucaacgagcugcccgagagccuggagacgcucaugcugguggcccugcucggcgcgaugaccgccgggaucuuccuguucuucaugcagggcaaggggaucggcaagcugagcaugggccucaucaccaucgccguggccuccgggcugcugugggucgccgagauccagccccaguggaucgcggccagcaucauccucgaguucuuccugauggugcugcucaucccggagcccgagaagcagcggaccccccaggacaaccagcugaucuacgugauccugacgauccucaccaucaucggccugaucgccgccaacgagauggggcugaucgagaagaccaagaccgacuucggcuucuaccaggucaagacggagaccaccauccucgacguggaccugcgccccgccuccgcguggacccuguacgccguggccacgaccauccucaccccgaugcugcggcacaccaucgagaacacgagcgccaaccugucccucgccgcgaucgccaaccaggccgccauccugauggggcugggcaagggcuggccccuccaccgcauggaccugggggucccccugcucgccaugggcugcuacagccaggugaaccccaccacccugaccgcgucccuggugaugcuccugguccacuacgccaucaucgggccgggccugcaggccaaggccacgcgggaggcgcagaagcgcaccgccgccggcaucaugaagaaccccaccguggacgggaucaccgugaucgaccucgagcccaucagcuacgaccccaaguucgagaagcagcugggccaggucaugcugcucgcccugugcgccgggcagcugcuccugaugcggacgaccugggcguucugcgaggugcugacccucgccaccggcccgauccugacgcugugggaggggaaccccggccgcuucuggaacaccaccaucgccguguccaccgccaacaucuuccggggcagcuaccucgccggggcgggccuggccuucucccugaucaagaacgcccagacgccccgccgggggaccggcaccaccggggagacccucggcgagaaguggaagcgccagcugaacagccuggaccggaaggaguucgaggaguacaagcgcuccggcauccucgaggucgaccggacggaggccaagagcgcccugaaggacggguccaagaucaagcacgcggugagccgcggcuccagcaagauccgguggaucguggagcgcgggauggucaagcccaagggcaaggugguggaccuggggugcggccgcggcgggugguccuacuacauggccacccucaagaacgucaccgaggugaagggcuacaccaaggggggcccggggcacgaggagcccauccccauggccacguacggcuggaaccuggugaagcugcacagcggcgucgacguguucuacaagcccaccgagcagguggacacccuccugugcgacaucggggagagcuccagcaacccgaccaucgaggagggccggacgcugcgcguccucaagaugguggagcccuggcuguccagcaagcccgaguucugcaucaaggugcugaaccccuacaugccgaccgucaucgaggagcuggagaagcuccagcggaagcacgggggcaaccuggugcgcugcccccugucccggaacagcacccacgagauguacuggguguccggcgccagcgggaacaucgucuccagcgugaacaccacguccaagaugcuccugaaccgcuucaccacccggcaccgcaagcccaccuacgagaaggacgucgaccugggcgcggggacgcggagcguguccaccgagaccgagaagcccgacaugaccaucaucggccgccggcuccagcgccugcaggaggagcacaaggagacguggcacuacgaccaggagaacccguaccggaccugggccuaccacgggagcuacgaggcccccuccaccggcagcgccuccagcauggugaacggcgucgugaagcugcucaccaagcccugggacgugaucccgauggucacgcagcuggccaugaccgacaccacccccuucgggcagcagcgcguguucaaggagaagguggacacgcggaccccccagcccaagccgggcacccgcauggucaugaccacgaccgcgaacuggcugugggcccuccuggggaagaagaagaacccccggcugugcacccgcgaggaguucaucuccaaggugcggagcaacgccgccaucggcgccguguuccaggaggagcagggguggaccagcgcguccgaggccgucaacgacagccgcuucugggagcucguggacaaggagcgggcccugcaccaggagggcaagugcgaguccugcguguacaacaugaugggcaagcgcgagaagaagcugggggaguucggccgcgccaaggggagccgggccaucugguacauguggcucggcgcgcgcuuccuggaguucgaggcccugggguuccucaacgaggaccacugguucggccgggagaacuccuggagcggcgucgagggggagggccugcaccgccugggguacauccucgaggagaucgacaagaaggacggcgaccugauguacgccgacgacacggccggcugggacacccggaucaccgaggacgaccugcagaacgaggagcucaucaccgagcagauggcgccccaccacaagauccuggccaaggccaucuucaagcugaccuaccagaacaagguggugaagguccuccgccccacgccgcggggggccgugauggacaucaucucccgcaaggaccagcggggcagcgggcaggugggcaccuacgggcugaacaccuucaccaacauggagguccagcugauccgccagauggaggccgagggcgugaucacgcaggacgacaugcagaaccccaagggccucaaggagcggguggagaaguggcugcgcgagugcggggucgaccggcugaagcgcauggcgaucuccggcgacgacugcguggugaagccccucgacgagcgguucgggaccagccugcuguuccucaacgacaugggcaagguccgcaaggacaucccccagugggagccguccaagggguggaagaacuggcaggaggugcccuucugcagccaccacuuccacaagaucuucaugaaggacggccggucccuggugguccccugccgcaaccaggacgagcugaucggccgggcccgcaucagccagggggccggcuggucccuccgcgagaccgccugccuggggaaggccuacgcgcagauguggagccugauguacuuccaccggcgcgaccuccggcuggccuccauggccaucugcagcgccgugcccaccgagugguucccgacgagccgcaccaccugguccauccacgcccaccaccaguggaugaccacggaggacaugcugaagguguggaaccgggucuggaucgaggacaaccccaacaugaucgacaagacccccgugcacagcugggaggacauccccuaccucggcaagcgcgaggaccuguggugcgggucccugaucggccucagcucccgggcgaccugggccaagaacauccacaccgccaucacgcaggugcgcaaccugaucggcaaggaggaguacgucgacuacaugccggugaugaagcgguacagcgcccccuccgagagcgagggggugcuguga

SEQ ID NO: 10536 - RNA, 9867 nt, Artificial Sequence
  derived and/or modified CDS sequence (opt1) from DENV-4__HQ332176__SS-prME
agcaccaucacccugcucugccugauccccacggugauggccuuccaccuguccacccgcgacggcgagccgcucaugaucgucgcccggcacgagcgcgggcggccccugcuguucaagaccaccgagggcaucaacaagugcacgcucaucgcgauggaccugggggagaugugcgaggacaccgugaccuacaagugcccccugcucgugaacaccgagcccgaggacaucgacugcuggugcaaccugacgagcaccugggucauguacggcaccugcacccaguccggggagcgccggcgcgagaagcggagcguggcccugacgccgcacuccggcaugggccucgagacccgcgccgagaccuggaugagcuccgagggggccuggaagcacgcccagcggguggagagcuggauccugcgcaaccccggcuucgcgcugcucgccggguucauggccuacaugaucggccagaccgggauccagcggacggucuucuucgugcugaugaugcugguggcccccuccuacggcaugcgcugcgucggcguggggaaccgggacuucguggagggcgucagcgggggcgcguggguggaccucgugcuggagcacggcgggugcgucaccaccauggcccagggcaagcccacccuggacuucgagcucacgaagaccaccgccaaggagguggcccugcugcgcaccuacugcaucgaggcccucaucuccaacaucacgaccgcgacccggugcccgacccagggggagcccuaccugaaggaggagcaggaccagcaguacaucugccgccgggacguggucgaccgcggcugggggaacggcugcggccuguucgggaagggcgggguggugacgugcgccaaguucagcugcuccggcaagaucaccgggaaccucguccagaucgagaaccuggaguacaccgugguggucaccgugcacaacggcgacacgcacgccgucggcaacgacaccagcaaccacggggugaccgccaccaucacgccccggucccccagcguggaggucaagcugccggacuacggcgagcucacccuggacugcgagccccgcuccgggaucgacuucaacgagaugauccugaugaagaugaagaagaagaccuggcucgugcacaagcagugguuccuggaccugccccuccccuggaccaccggcgccgacacgagcgaggugcacuggaacuacaaggagcggauggucaccuucaaggugccgcacgcgaagcgccaggacgugaccguccuggggucccaggagggcgccaugcacagcgcccuggccggcgccaccgagguggacagcggggacggcaaccacauguucgcggggcaccucaagugcaaggugcgcauggagaagcugcggaucaagggcauguccuacacgaugugcagcggcaaguucuccaucgacaaggagauggccgagacccagcacgggaccaccgucgugaaggugaaguacgagggcgccggggcccccugcaagguccccaucgagauccgcgacgugaacaaggagaagguggucggccgggugaucagcgccacgccccuggcggagaacaccaacuccgugaccaacaucgagcucgagccgcccuucggggacagcuacaucgucaucggcgugggcaacuccgcccugacccugcacugguuccgcaaggggagcuccaucggcaagauguucgagagcacguaccggggggccaagcgcauggccauccucggcgagaccgcgugggacuucggguccgugggcggccuguucaccagccuggggaaggccguccaccagguguucggcuccguguacaccacgauguucgggggcgucagcuggaugauccggauccucaucggguuccuggugcuguggaucggcaccaacucccgcaacaccagcauggccaugaccugcaucgccgugggcgggaucacgcuguuccucggcuucaccguccaggccgacauggggugcgugguguccuggagcggccgggagcugaagugcggguccggcaucuucgucguggacaacgugcacaccuggaccgagcaguacaaguuccagcccgagagccccgcgcgccuggccagcgccauccucaacgcccacaaggacggcgucugcgggauccgguccacgacccgccuggagaacgugauguggaagcagaucaccaacgagcugaacuacgugcucugggagggcgggcacgaccugaccgucguggccggcgacgugaagggcguccugacgaaggggaagcgggcgcucaccccgcccgccagcgaccugaaguacuccuggaagaccuggggcaaggccaagaucuucacccccgaggcccgcaacagcacguuccugaucgacgggcccgacaccuccgagugcccgaacgagcggcgcgccuggaacagcuucgagguggaggacuacggcuucgggauguucaccaccaacaucuggaugaaguuccgggagggcuccagcgaggugugcgaccaccgccucauguccgcggccaucaaggaccagaaggccguccacgccgacaugggcuacuggaucgagagcuccaagaaccagacguggcagaucgagcgggcgagccugaucgaggugaagaccugccuguggcccaagacccacacccucugguccaacggggugcuggagagccagaugcugauccccaaguccuacgccggcccguucagccagcacaacuaccgccagggguacgccacccagacggucggccccuggcaccucgggaagcuggagaucgacuucggcgagugccccggcaccaccgugaccauccaggagaacugcgaccaccgcgggcccucccugcggacgaccaccgccagcggcaagcucgugacccaguggugcugccgcagcugcacgaugccgccccugcgguuccugggggaggacggcugcugguacgggauggagauccgcccccucuccgagaaggaggagaacauggucaagagccaggugaccgccggccagggcaccuccgagaccuucagcauggggcugcugugccucacgcuguucgucgaggagugccugcggcgccgggugacccgcaagcacaugauccucgcgguggucaucacccugugcgccaucauccugggcgggcucaccuggauggaccugcugcgggcccucaucaugcugggcgacacgauguccggccgcaucgggggccagacccaccuggccaucauggccguguucaagaugagccccggguacgugcucggcgucuuccugcggaagcugaccucccgcgagaccgcgcucauggugaucgggauggccaugacgaccacccugagcaucccgcacgaccugauggagcucaucgacggcaucucccugggccugauccuccugaagaucgugacccaguucgacaacacgcaggucgggacccuggcccucagccugaccuucauccgguccaccaugagccuggugauggccuggcgcacgaucauggccgugcucuucgucgugacccugaucccccugugccggaccuccugccuccagaagcagagccacuggguggagaucaccgcgcugauccugggcgcccaggcccuccccgucuaccugaugacgcugaugaagggggccucccgccggagcuggccccucaacgagggcaucauggcgguggggcuggugucccugcucggcagcgcccugcugaagaacgacgucccgcucgccggccccaugguggccgggggccugcugcucgccgcguacgugauguccgggagcagcgccgaccugucccuggagaaggccgccaacguccagugggacgagauggccgacaucaccggcagcucccccaucaucgaggugaagcaggacgaggacgggagcuucuccauccgcgacguggaggagaccaacaugaucacccuccuggucaagcuggcgcucaucacggugagcggccuguacccccuggccaucccgaucaccaugacccucugguacauguggcaggugaagacccagcgguccggcgcccugugggacguccccagccccgccgccacccagaaggcggcccuguccgaggggguguaccgcaucaugcagcggggccucuucgggaagacgcaggugggcgucgggauccacauggagggcguguuccacaccauguggcacgugacccgcggcagcgucaucugccacgagaccgggcgccuggagcccuccugggccgacgugcggaacgacaugaucagcuacggcgggggcuggcgccugggcgacaagugggacaaggaggaggacgugcagguccucgccaucgagccggggaagaaccccaagcacgugcagacgaagcccggccuguucaagacccugaccggggagaucggcgccgugacccucgacuucaagcccgggacguccggcagcccgaucaucaaccggaagggcaaggucaucgggcuguacggcaacgggguggugaccaaguccggcgacuacgucagcgcgaucacccaggccgagcgcaucggggagcccgacuacgagguggacgaggacaucuuccggaagaagcgccugaccaucauggaccuccaccccggcgccggcaagacgaagcggauccugccguccaucgugcgcgaggcccugaagcggcgccugcggacccucauccuggcgcccacccgcgucguggccgccgagauggaggaggcccugcgggggcuccccauccgcuaccagacccccgccgugaagagcgagcacacgggccgggagaucgucgaccugaugugccacgcgaccuucaccacccgccugcucuccagcacgcgggugccgaacuacaaccugaucgugauggacgaggcccacuucaccgaccccagcuccgucgccgcccgcggguacaucagcacccggguggagaugggcgaggccgcggccaucuucaugaccgccacgccccccggggccaccgacccguucccccaguccaacagccccaucgaggacaucgagcgcgagauccccgagcgcuccuggaacaccggcuucgacuggaucaccgacuaccagggcaagacggucugguucgugccgagcaucaaggccgggaacgacaucgcgaacugccugcggaaguccggcaagaaggugauccagcucagccgcaagaccuucgacaccgaguaccccaagaccaagcugacggacugggacuucgucgugaccaccgacaucuccgagaugggggccaacuuccgggccggccgcgugaucgacccccggcgcugccugaagcccgucauccucaccgacgggccggagcgggugauccuggccggccccauccccgugacgcccgcgagcgccgcccagcgccggggccgcaucgggcggaacccggcccaggaggacgaccaguacgucuucuccggcgacccccugaagaacgacgaggaccacgcccacuggaccgaggcgaagaugcuccuggacaacaucuacacccccgaggggaucauccccacccuguucggcccggagcgcgagaagacgcaggccaucgacggcgaguuccggcuccgcggggagcagcggaagaccuucguggagcugaugcgccggggcgaccugcccguguggcucagcuacaaggucgccuccgccgggaucagcuacaaggaccgcgaguggugcuucaccggcgagcggaacaaccagauccuggaggagaacauggagguggagaucuggacccgcgagggggagaagaagaagcugcggcccaaguggcucgacgcccgcguguacgcggaccccauggcccugaaggacuucaaggaguucgccuccggccgcaagagcaucacccuggacauccucacggagaucgccucccugccgaccuaccugagcucccgggccaagcucgcgcuggacaacaucgucaugcugcacaccaccgagcgcggcgggcgggccuaccagcacgcccucaacgagcugcccgagagccuggagacgcucaugcugguggcccugcucggcgcgaugaccgccgggaucuuccuguucuucaugcagggcaaggggaucggcaagcugagcaugggccucaucaccaucgccguggccuccgggcugcugugggucgccgagauccagccccaguggaucgcggccagcaucauccucgaguucuuccugauggugcugcucaucccggagcccgagaagcagcgcaccccccaggacaaccagcugaucuacgugauccugacgauccucaccaucaucggccugaucgccgccaacgagauggggcugaucgagaagaccaagaccgacuucggcuucuaccaggucaagacggagaccaccauccucgacguggaccugcggcccgccuccgcguggacccuguacgccguggccacgaccauccucaccccgaugcugcgccacaccaucgagaacacgagcgccaaccugucccucgccgcgaucgccaaccaggccgccguccugauggggcugggcaagggcuggccccuccaccggauggaccugggggugccccugcucgccaugggcugcuacagccaggugaaccccaccacccugaccgcgucccuggucaugcuccuggugcacuacgccaucaucgggccgggccugcaggccaaggccacgcgcgaggcgcagaagcggaccgccgccggcaucaugaagaaccccaccguggacgggaucaccgucaucgaccucgagcccaucagcuacgaccccaaguucgagaagcagcugggccaggugaugcugcucgugcugugcgccgggcagcugcuccugaugcgcacgaccugggccuucugcgagguccugacccucgcgaccggcccgauccugacgcugugggaggggaaccccggccgguucuggaacaccaccaucgccguguccaccgccaacaucuuccgcggcagcuaccucgccggggccggccuggcguucucccugaucaagaacgcccagacgccccggcgcgggaccggcaccaccggggagacccucggcgagaaguggaagcggcagcugaacagccuggaccgcaaggaguucgaggaguacaagcgguccggcauccucgagguggaccgcacggaggccaagagcgcccugaaggacggguccaagaucaagcacgccgucagccggggcuccagcaagauccgcuggaucguggagcgcgggauggugaagcccaagggcaaggucguggaccuggggugcggccggggcgggugguccuacuacauggcgacccucaagaacgugaccgaggucaagggcuacaccaaggggggcccggggcacgaggagcccauccccauggccacguacggcuggaaccuggugaagcugcacagcggcguggacgucuucuacaagcccaccgagcagguggacacccuccugugcgacaucggggagagcuccagcaacccgaccaucgaggagggccgcacgcugcgggugcucaagauggucgagcccuggcuguccagcaagcccgaguucugcaucaaggugcugaaccccuacaugccgaccgugaucgaggagcuggagaagcuccagcgcaagcacgggggcaaccugguccggugcccccugucccgcaacagcacccacgagauguacuggguguccggcgccagcgggaacaucgucuccagcgugaacaccacguccaagaugcuccugaaccgguucaccacccgccaccggaagcccagcuacgagaaggacguggaccugggcgccgggacccgcuccgucagcacggagaccgagaagcccgacaugaccaucaucggccggcgccuccagcggcugcaggaggagcacaaggagaccuggcacuacgaccaggagaacccguaccgcacgugggcguaccacggguccuacgaggcccccagcaccggcuccgccagcuccauggugaacggcguggucaagcugcucaccaagcccugggacgugaucccgauggugacccagcuggccaugacggacaccacccccuucgggcagcagcgggucuucaaggagaagguggacacccgcacgccccagcccaagccgggcacccggauggugaugaccaccacggccaacuggcugugggcgcuccuggggaagaagaagaacccccgccugugcacccgggaggaguucaucagcaagguccgcagcaacgccgccaucggcgccguguuccaggaggagcagggguggaccuccgccagcgaggcggugaacgacucccgguucugggagcucgucgacaaggagcgcgcccugcaccaggagggcaagugcgagagcugcguguacaacaugaugggcaagcgcgagaagaagcugggggaguucggccgggccaaggggucccgcgccaucugguacauguggcucggcgcccgguuccuggaguucgaggcgcugggguuccucaacgaggaccacugguucggccgcgagaacagcugguccggcguggagggggagggccugcaccggcugggguacauccucgaggagaucgacaagaaggacggcgaccugauguacgccgacgacaccgccggcugggacacgcgcaucaccgaggacgaccugcagaacgaggagcucaucaccgagcagauggccccccaccacaagauccuggcgaaggccaucuucaagcugaccuaccagaacaaggucgugaaggugcuccggcccaccccgcgcggggccgucauggacaucaucagccggaaggaccagcgcggcuccgggcaggugggcacguacgggcugaacaccuucaccaacauggaggugcagcugauccggcagauggaggccgagggcgucaucacccaggacgacaugcagaaccccaagggccucaaggagcgcguggagaaguggcugcgggagugcgggguggaccgccugaagcggauggccaucagcggcgacgacugcgucgugaagccccucgacgagcgcuucgggacgucccugcuguuccucaacgacaugggcaaggugcggaaggacaucccccagugggagccgagcaagggguggaagaacuggcaggagguccccuucugcucccaccacuuccacaagaucuucaugaaggacggccgcagccugguggugcccugccggaaccaggacgagcugaucggccgcgcgcgcaucucccagggggccggcuggagccuccgggagaccgccugccuggggaaggccuacgcccagauguggucccugauguacuuccaccgccgggaccuccgccuggcgagcauggccaucugcagcgccguccccaccgagugguucccgaccucccggacgaccuggagcauccacgcccaccaccaguggaugaccaccgaggacaugcugaagguguggaaccgcguguggaucgaggacaaccccaacaugaucgacaagacgcccguccacuccugggaggacauccccuaccucggcaagcgggaggaccuguggugcgggagccugaucggccucuccagccgcgccaccugggcgaagaacauccacaccgccaucacccaggugcggaaccugaucggcaaggaggaguacguggacuacaugccggucaugaagcgcuacuccgcccccagcgaguccgagggggugcuguga

SEQ ID NO: 10537 - RNA, 9867 nt, Artificial Sequence
  derived and/or modified CDS sequence (opt1) from DENV-4__HQ332174__SS-prME
agcaccaucacccugcucugccugauccccaccgcgauggccuuccaccuguccacccgggacggcgagccccucaugaucguggcgaagcacgagcgggggcgcccccugcuguucaagaccaccgagggcaucaacaagugcacccucaucgccauggaccugggggagaugugcgaggacaccgugaccuacaagugcccccugcucgugaacaccgagcccgaggacaucgacugcuggugcaaccugacgagcaccugggugauguacgggaccugcacccaguccggggagcggcgccgggagaagcgcagcguggcccugacgccgcacuccggcaugggccucgagacccgggccgagaccuggaugagcuccgagggggccuggaagcacgcgcagcgcguggagagcuggauccugcggaaccccggcuucgcccugcucgccggguucauggccuacaugaucggccagaccgggauccagcgcacgguguucuucguccugaugaugcugguggcgcccuccuacggcaugcggugcgugggcgucgggaaccgcgacuucguggagggcgugagcgggggcgccugggucgaccucgugcuggagcacggcgggugcgugaccaccauggcccagggcaagcccacccuggacuucgagcucacgaagaccaccgccaaggaggucgcccugcugcggaccuacugcaucgaggcgcucaucuccaacaucacgaccgccacccgcugcccgacccagggggagcccuaccugaaggaggagcaggaccagcaguacaucugccggcgcgacgugguggaccggggcugggggaacggcugcggccuguucgggaagggcggggucgugacgugcgccaaguucagcugcuccggcaagaucaccgggaaccucgugcagaucgagaaccuggaguacaccgucguggugaccguccacaacggcgacacgcacgccgugggcaacgacaccagcaaccacggggucaccgccaccaucacgccccgcucccccagcguggaggugaagcugccggacuacggcgagcucacccuggacugcgagccccgguccgggaucgacuucaacgagaugauccugaugaagaugaagaagaagaccuggcucguccacaagcagugguuccuggaccugccccuccccuggaccaccggcgcggacacgagcgaggugcacuggaacuacaaggagcgcauggugaccuucaaggucccgcacgccaagcggcaggacgugaccgugcuggggucccaggagggcgccaugcacagcgcccuggccggcgcgaccgaggucgacagcggggacggcaaccacauguucgccgggcaccucaagugcaaggugcgcauggagaagcugcgcaucaagggcauguccuacacgaugugcagcggcaaguucuccaucgacaaggagauggccgagacccagcacgggaccaccguggucaaggugaaguacgagggcgccggggcccccugcaaggugcccaucgagauccgggacgucaacaaggagaagguggugggccgcgucaucagcgcgacgccccuggccgagaacaccaacuccgugaccaacaucgagcucgagccgcccuucggggacagcuacaucgugaucggcgucggcaacuccgcccugacccugcacugguuccggaaggggagcuccaucggcaagauguucgagagcacguaccgcggggccaagcggauggcgauccucggcgagaccgccugggacuucggguccgugggcggccuguucaccagccuggggaaggccgugcaccaggucuucggcuccguguacaccacgauguucgggggcgugagcuggaugauccgcauccucaucggguuccugguccuguggaucggcaccaacucccggaacaccagcauggccaugaccugcaucgccgugggcgggaucacgcuguuccucggcuucaccgugcaggcggacauggggugcgucguguccuggagcggccgcgagcugaagugcggguccggcaucuucguggucgacaacgugcacaccuggaccgagcaguacaaguuccagcccgagagccccgcccggcuggccagcgccauccucaacgcccacaaggacggcgugugcgggauccgcuccacgacccggcuggagaacgucauguggaagcagaucaccaacgagcugaacuacgugcucugggagggcgggcacgaccugaccguggucgcgggcgacgugaagggcgugcugacgaaggggaagcgcgcccucaccccgcccgccagcgaccugaaguacuccuggaagaccuggggcaaggccaagaucuucacccccgaggcccggaacagcacguuccugaucgacgggcccgacaccuccgagugcccgaacgagcgccgggcguggaacagcuucgaggucgaggacuacggcuucgggauguucaccaccaacaucuggaugaaguuccgcgagggcuccagcgaggugugcgaccaccggcucauguccgccgccaucaaggaccagaaggccgugcacgcggacaugggcuacuggaucgagagcuccaagaaccagacguggcagaucgagcgcgccagccugaucgaggucaagaccugccuguggcccaagacccacacccucugguccaacggggugcuggagagccagaugcugauccccaaguccuacgccggcccguucagccagcacaacuaccggcagggguacgccacccagacgaugggccccuggcaccucgggaagcuggagaucgacuucggcgagugccccggcaccaccgugaccauccaggagaacugcgaccaccgcgggcccucccugcgcacgaccaccgccagcggcaagcucgucacccaguggugcugccggagcugcacgaugccgccccugcgcuuccugggggaggacggcugcugguacgggauggagauccggccccucuccgagaaggaggagaacauggucaagagccaggugaccgcgggccagggcgccuccgagaccuucagcauggggcugcugugccucacccuguucgucgaggagugccugcgccggcgcgugacgcggaagcacaugauccucgccgucgugaucacccugugcgccaucauccugggcgggcucaccuggauggaccugcugcgcgcccucaucaugcugggcgacaccauguccggccggaucgggggccagacgcaccuggcgaucauggccguguucaagaugagccccggguacguccucggcguguuccugcgcaagcugaccucccgggagaccgcccucauggugaucgggauggccaugaccacgacccugagcaucccgcacgaccugauggagcucaucgacggcaucucccugggccugauccuccugaagaucgucacccaguucgacaacacccagguggggacgcuggcccucagccugaccuucauccgcuccaccaugagccuggugauggcguggcggaccaucauggccguccucuucguggugacgcugaucccccugugccgcaccuccugccuccagaagcagagccacugggucgagaucaccgcccugauccugggcgcccaggcgcuccccguguaccugaugacccugaugaagggggccucccggcgcagcuggccccucaacgagggcaucauggccguggggcuggucucccugcucggcagcgcccugcugaagaacgacgugccgcucgccggccccaugguggccggcgggcugcugcucgccgccuacgucauguccgggagcagcgccgaccugucccuggagaaggccgcgaacgugcagugggacgagauggccgacaucacggggagcucccccaucaucgaggugaagcaggacgaggacgggagcuucuccauccgggacgucgaggagaccaacaugaucacccuccuggugaagcuggcccucaucaccgugagcggccuguacccccuggccaucccgaucacgaugacccucugguacauguggcaggucaagacccagcgcuccggcgcccugugggacgugcccagccccgcggccacccagaaggccgcccuguccgaggggguguaccggaucaugcagcgcggccucuucgggaagacccaggucggcguggggauccacauggagggcguguuccacacgauguggcacgucacccggggcagcgugaucugccacgagaccgggcgccuggagcccuccugggccgacgugcgcaacgacaugaucagcuacggcgggggcuggcggcugggcgacaagugggacaaggaggaggacguccaggugcucgcgaucgagccggggaagaaccccaagcacgugcagaccaagcccggccuguucaagacgcugaccggggagaucggcgccgucacccucgacuucaagcccgggaccuccggcagcccgaucaucaaccgcaagggcaaggugaucgggcuguacggcaacgggguggucacgaaguccggcgacuacgugagcgccaucacccaggccgagcggaucggggagcccgacuacgagguggacgaggacaucuuccgcaagaagcggcugaccaucauggaccuccaccccggcgcgggcaagaccaagcgcauccugccguccaucguccgggaggcccugaagcgccggcugcgcacgcucauccuggcccccacccgggugguggccgccgagauggaggaggcgcugcgcgggcuccccauccgguaccagacccccgccgucaagagcgagcacaccggccgcgagaucguggaccugaugugccacgccacguucaccacccggcugcucuccagcacccgcgugccgaacuacaaccugaucgucauggacgaggcccacuucacggaccccagcuccguggccgcgcggggguacaucagcacccgcguggagaugggcgaggccgccgccaucuucaugaccgccacgccgcccggggcgacggacccguucccccaguccaacagccccaucgaggacaucgagcgggagauccccgagcgcuccuggaacaccggcuucgacuggaucaccgacuaccagggcaagaccgucugguucgugccgagcaucaaggccgggaacgacaucgccaacugccugcgcaaguccggcaagaaggucauccagcucagccggaagacguucgacaccgaguaccccaagaccaagcugaccgacugggacuucguggugacgaccgacaucuccgagaugggggccaacuuccgcgcgggccgggucaucgacccccgccggugccugaagcccgugauccucaccgacgggccggagcgcgugauccuggccggccccauccccgucacccccgccagcgccgcccagcggcgcggccggaucgggcgcaacccggcgcaggaggacgaccaguacguguucuccggcgacccccugaagaacgacgaggaccacgcccacuggacggaggccaagaugcuccuggacaacaucuacacccccgaggggaucauccccacccuguucggcccggagcgggagaagacccaggccaucgacggcgaguuccgccuccgcggggagcagcgcaagacguucguggagcugaugcggcgcggcgaccugcccgucuggcucagcuacaagguggccuccgcggggaucagcuacaaggaccgggaguggugcuucaccggcgagcgcaacaaccagauccuggaggagaacauggagguggagaucuggacccgggagggggagaagaagaagcugcgccccaaguggcucgacgcccgggucuacgccgaccccauggcccugaaggacuucaaggaguucgccuccggccgcaagagcaucacccuggacauccucaccgagaucgcgucccugccgacguaccugagcucccgcgccaagcucgcccuggacaacaucgugaugcugcacaccaccgagcggggcgggcgcgccuaccagcacgcgcucaacgagcugcccgagagccuggagacccucaugcugguggcccugcucggcgccaugacggccgggaucuuccuguucuucaugcagggcaaggggaucggcaagcugagcaugggccucaucaccaucgccgucgcguccgggcugcuguggguggccgagauccagccccaguggaucgccgccagcaucauccucgaguucuuccugauggugcugcucaucccggagcccgagaagcagcggacgccccaggacaaccagcugaucuacgucauccugaccauccucacgaucaucggccugaucgccgcgaacgagauggggcugaucgagaagaccaagaccgacuucggcuucuaccaggccaagaccgagacgaccauccucgacguggaccugcgccccgccuccgccuggacccuguacgccguggcgaccacgauccucaccccgaugcugcggcacaccaucgagaacaccagcgccaaccugucccucgccgccaucgccaaccaggcggccguccugauggggcugggcaagggcuggccccuccaccgcauggaccugggggugccccugcucgccaugggcugcuacagccaggugaaccccacgacccugaccgccucccuggucaugcuccuggugcacuacgcgaucaucgggccgggccugcaggccaaggccacccgggaggcccagaagcgcacggccgcgggcaucaugaagaaccccaccguggacgggaucaccgucaucgaccucgagcccaucagcuacgaccccaaguucgagaagcagcugggccaggugaugcugcucgugcugugcgccgggcagcugcuccugaugcggaccacgugggccuucugcgagguccugacccucgccaccggcccgauccugacccugugggaggggaaccccggccgcuucuggaacacgaccaucgccguguccaccgcgaacaucuuccggggcagcuaccucgccggggccggccuggccuucucccugaucaagaacgcccagacgccccggcgggggacgggcaccaccggggagacccucggcgagaaguggaagcgccagcugaacagccuggaccggaaggaguucgaggaguacaagcgcuccggcauccucgagguggaccggaccgaggccaagagcgcccugaaggacggguccaagaucaagcacgccgucagccgcggcuccagcaagauccgguggaucguggagcgcgggauggugaagcccaagggcaaggucguggaccuggggugcggccgcggcgggugguccuacuacauggccacgcucaagaacgugaccgaggucaagggcuacaccaagggcggcccggggcacgaggagcccauccccauggcgaccuacggcuggaaccuggugaagcugcacagcggcguggacgucuucuacaagcccacggagcaggucgacacccuccugugcgacaucggggagagcuccagcaacccgaccaucgaggagggccggacccugcgcgugcucaagauggucgagcccuggcuguccagcaagcccgaguucugcaucaaggugcugaaccccuacaugccgacggugaucgaggagcuggagaagcuccagcggaagcacgggggcaaccugguccgcugcccccugucccggaacagcacccacgagauguacuggguguccggcgccagcgggaacaucguguccagcgucaacaccaccuccaagaugcuccugaaccgcuucacgacccggcaccgcaagcccaccuacgagaaggacguggaccugggcgccgggacccggagcgucuccacggagaccgagaagcccgacaugaccaucaucggccgccggcuccagcgccugcaggaggagcacaaggagaccuggcacuacgaccaggagaacccguaccggacgugggccuaccacgggagcuacgaggcccccuccaccggcagcgcguccagcauggugaacggcguggucaagcugcucaccaagcccugggacgugaucccgauggugacccagcuggccaugacggacaccacccccuucgggcagcagcgcgucuucaaggagaagguggacacccggacgccccagcccaagccgggcacccgcaccgugaugaccacgaccgccaacuggcugugggcccuccuggggaagaagaagaacccccggcugugcacccgcgaggaguucaucuccaagguccggagcaacgccgcgaucggcgccguguuccaggaggagcagggguggaccagcgccuccgaggccgugaacgacagccgcuucugggagcucgucgacaaggagcgggcccugcaccaggagggcaagugcgaguccugcguguacaacaugaugggcaagcgcgagaagaagcugggggaguucggccgcgcgaaggggagccgggccaucugguacauguggcucggcgcccgcuuccuggaguucgaggcccugggguuccucaacgaggaccacugguucggccgggagaacuccuggagcggcguggagggggagggccugcaccgccugggguacauccucgaggagaucgacaagaaggacggcgaccugauguacgcggacgacacggccggcugggacacccggaucaccgaggacgaccugcagaacgaggagcucaucaccgagcagauggcgccccaccacaagauccuggccaaggccaucuucaagcugaccuaccagaacaaggucgugaaggugcuccgccccacgccgcgcggggcggucauggacaucaucucccgcaaggaccagcggggcagcggccaggugggcaccuacgggcugaacaccuucaccaacauggaggugcagcugauccgccagauggaggccgagggcgucaucacgcaggacgacaugcagaaccccaagggccucaaggagcggguggagaaguggcugcgcgagugcgggguggaccggcugaagcgcauggccaucuccggcgacgacugcgucgugaagccccucgacgagcgguucgggaccagccugcuguuccucaacgacaugggcaaggugcgcaaggacaucccccagugggagccguccaagggguggaagaacuggcaggagguccccuucugcagccaccacuuccacaagaucuucaugaaggacggccggucccugguggugcccugccgcaaccaggacgagcugaucggccgggcccgcaucagccagggggccggcuggucccuccgcgagaccgcgugccuggggaaggccuacgcccagauguggagccugauguacuuccaccggcgcgaccuccggcuggccuccauggccaucugcagcgcgguccccaccgagugguucccgacgagccgcaccaccugguccauccacgcccaccaccaguggaugaccacggaggacaugcugaagguguggaaccggguguggaucgaggacaaccccaacaugaucgacaagacccccguccacagcugggaggacauccccuaccucggcaagcgcgaggaccuguggugcgggucccugaucggccucagcucccgggccaccugggccaagaacauccacaccgccaucacccaggugcgcaaccugaucggcaaggaggaguacguggacuacaugccggucaugaagcgguacagcgcgcccuccgagagcgagggggugcuguga

SEQ ID NO: 10538 - RNA, 9867 nt, Artificial Sequence
  derived and/or modified CDS sequence (opt1) from DENV-4__KT026308__SS-prME
agcaccaucacccugcucugccugauccccacggugauggccuuccaccuguccacccgcgacggcgagccgcucaugaucgucgccaagcacgagcgggggcgcccccugcuguucaagaccaccgagggcaucaacaagugcacgcucaucgcgauggaccugggggagaugugcgaggacaccgugaccuacaagugcccccugcucgugaacaccgagcccgaggacaucgacugcuggugcaaccugacgagcaccugggucauguacggcaccugcacccaguccggggagcggcgccgggagaagcgcagcguggcccugacgccgcacuccggcaugggccucgagacccgggccgagaccuggaugagcuccgagggggccuggaagcacgcccagcgcguggagagcuggauccugcggaaccccggcuucgcgcugcucgccggguucauggccuacaugaucggccagaccgggauccagcgcacggucuucuucauccugaugaugcugguggcccccuccuacggcaugcggugcgugggcgucgggaaccgcgacuucguggagggcgugagcgggggcgcgugggucgaccucgugcuggagcacggcgggugcgugaccaccauggcccagggcaagcccacccuggacuucgagcucaucaagacgaccgccaaggaggucgcccugcugcggaccuacugcaucgaggccuccaucagcaacaucaccacggcgacccgcugcccgacccagggggagcccuaccucaaggaggagcaggaccagcaguacaucugccggcgcgacaugguggaccggggcugggggaacggcugcggccuguucgggaagggcgggguggucaccugcgccaaguucuccugccugggcaagaucacggggaaccucgugcagaucgagaaccuggaguacaccguggucgugaccgugcacaacggcgacacccacgccgucggcaacgacacgagcaaccacggggugaccgccaccaucaccccccgcucccccagcgucgaggugcagcugccggacuacggcgagcucacgcuggacugcgagccccgguccgggaucgacuucaacgagaugauccugaugaagaugaagaccaagaccuggcucgugcacaagcagugguuccuggaccugccccuccccuggaccaccggcgccgacacgcuggagguccacuggaaccacaaggagcgcauggugaccuucaaggugccgcacgcgaagcggcaggacgucaccgugcuggggagccaggagggcgccaugcacuccgcccucgccggcgccaccgagguggacagcggggacggcaaccacauguucgcggggcaccugaagugcaagguccgcauggagaagcugcgcaucaagggcaugagcuacacgaugugcuccggcaaguucagcaucgacaaggagauggccgagacccagcacgggaccaccguggugaaggucaaguacgagggcacgggggcccccugcaaggugcccaucgagauccgggacgugaacaaggagaaggucgugggccgcaucaucuccagcacccccuucgccgagaacaccaacuccgugaccaacaucgagcucgagccgcccuucggggacagcuacaucgucaucggcgugggcgacuccgcccugacgcugcacugguuccggaaggggagcuccaucggcaagauguucgagagcaccuaccgcggggcgaagcggauggccauccucggcgagaccgccugggacuucggguccgugggcggccugcugaccagccucgggaaggccguccaccagguguucggcuccguguacacgaccauguucgggggcgucagcuggauggugcgcauccugaucgggcugcuggugcucuggaucggcaccaacucccggaacaccagcauggcgauguccugcaucgccgucggcgggaucacgcuguuccugggcuucaccgugcacgccgacauggggugcguggucagcugguccggcaaggagcucaagugcgggagcggcaucuucgugaucgacaacgugcacaccuggaccgagcaguacaaguuccagcccgagagccccgcccgccuggccuccgcgauccugaacgcccacaaggagggcgucugcgggauccggagcacgacccgccucgagaacgugauguggaagcagaucaccaacgagcugaacuacgugcugugggagggcgggcacgaccucaccgucguggccggcgacgugaagggcguccuguccaaggggaagcgggcccuggccccgcccgugaacgaccucaaguacagcuggaagacguggggcaaggcgaagaucuucacccccgagacccgcaacuccaccuuccugguggacgggcccgacacgagcgagugcccgaacgagcggcgcgccuggaacuuccuggaggucgaggacuacggcuucgggauguucaccaccaacaucuggaugaaguuccgggagggcuccagcgaggugugcgaccaccgccucauguccgccgccaucaaggaccagaaggccgugcacgcggacaugggcuacuggaucgagagcuccaagaaccagaccuggcagaucgagaaggccagccugaucgaggucaagacgugccuguggcccaagacccacacccucugguccaacggggugcuggagagccagaugcugauccccaaggccuacgccggcccgaucucccagcacaacuaccggcagggguacgcgacccagaccgccggccccuggcaccucgggaagcuggagaucgacuucggcgagugccccggcacgaccgugaccguccaggaggacugcgaccaccgcgggcccagccugcggaccacgaccgccuccggcaagcucgugacccaguggugcugccgcagcugcaccaugccgccccugcgcuuccugggggaggacggcugcugguacgggauggagauccggccccucaacgagaaggaggagaacauggugaagagccaggucuccgccggccacggcacgagcgagaccuucuccauggggcugcugugccucacccuguucguggaggagugccugcgccggcgcgucacccggaagcacaugauccucgugguggucacgacccugugcgccaucauccugggcgggcucaccuggauggaccugcugcgcgcgcucaucaugcugggcgacaccaugagcggccggauggggggccagauccaccuggccaucauggccguguucaagaugucccccggguacgugcucggcaucuuccugcgcaagcugacgagccgggagaccgcccucauggucaucgggauggccaugaccaccgugcuguccaucccgcacgaccugauggaguucaucgacggcaucagccucggccugauccugcucaagauggugacgcacuucgacaacacccaggucgggacccuggcgcuggcccucaccuucaucaaguccacgaugccccuggugauggccuggcgcaccaucauggccgugcuguucgucgugacccucaucccccugugccggaccagcugccugcagaagcagucccacuggguggagaucacggcccucauccugggcgcgcaggcccugcccgucuaccucaugacccugaugaagggggccagcaagcgcuccuggccgcugaacgagggcaucauggccguggggcucgugagccugcugggcuccgcgcuccugaagaacgacgucccccuggccggccccaugguggccgggggccuccugcuggccgccuacgugaugagcggguccagcgcggaccucucccuggagaaggccgccaacguccagugggacgagauggccgacaucaccggcagcagccccaucaucgaggugaagcaggacgaggacggguccuucagcauccgggacguggaggagaccaacaugaucacgcugcucgucaagcuggcccugaucaccguguccggccucuacccgcuggcgauccccgugaccaugacccugugguacauguggcaggucaagacgcagcgcagcggcgcccucugggacgugcccucccccgccgccgcccagaaggcgacccugaccgaggggguguaccggaucaugcagcgcggccuguucgggaagacccaggucggcguggggauccacaccgagggcguguuccacacgauguggcacgucacccggggcagcgugaucugccacgaguccgggcgccucgagccgagcugggccgacgugcggaacgacaugaucuccuacggcgggggcuggcgccugggcgacaagugggacaaggaggaggacguccaggugcuggccaucgagcccgggaagaaccccaagcacgugcagaccaagcccggccucuucaagacccugacgggggagaucggcgccgucacccuggacuucaagccggggaccagcggcucccccaucaucaaccggaagggcaaggugaucgggcucuacggcaacgggguggucaccaagagcggcgacuacguguccgccaucacgcaggcggagcgcaucggggagcccgacuacgagguggacgaggacaucuuccgcaagaagcggcugaccaucauggaccugcacccgggcgccggcaagaccaagcgcauccugcccagcaucguccgggaggcccucaagcgccggcugcgcacccugauccucgcccccacgcgggugguggcggccgagauggaggaggcccugcgcgggcugcccauccgguaccagaccccggccgucaaguccgagcacaccggccgcgagaucguggaccucaugugccacgccaccuucacgacccggcugcugagcuccacccgcgugcccaacuacaaccucaucgucauggacgaggcgcacuucaccgaccccagcuccguggccgcccggggguacaucagcacgcgcgucgagaugggcgaggccgccgcgguguucaugaccgccacccccccggggaccacggaccccuucccccagagcaacucccccaucgaggacaucgagcgggagaucccggagcgcagcuggaacaccggcuucgacuggaucaccgacuaccagggcaagaccgugugguucguccccuccaucaaggccgggaacgacaucgccaacugccugcggaagagcggcaagaaggugauccagcugucccgcaagacguucgacaccgaguaccccaagaccaagcucaccgacugggacuucgugaucacgaccgacaucagcgagaugggggccaacuuccgggcgggccgcgucaucgacccccgccggugccugaagccggugauccugaccgacgggcccgagcgcgugauccucgccggccccauccccgucaccccggccuccgccgcgcagcggcgcggccggaucgggcgcaaccccgcccaggaggacgaccaguacguguucagcggcgacccccugcggaacgacgaggaccacgcccacuggacggaggccaagaugcugcucgacaacaucuacacccccgaggggaucaucccgacccuguucggccccgagcgcgagaagacccaggccaucgacggcgaguuccggcugcgcggggagcagcggaagacguucguggagcucaugcgccggggcgaccugcccgucuggcugucccacaagguggcgagcgccgggaucuccuacaaggaccgcgaguggugcuucaccggcgagcggaacaaccagauccucgaggagaacauggagguggagaucuggacccgcgagggggagaagaagaagcugcggcccaaguggcuggacgcccgcgucuacgccgacccgauggcccucaaggacuucaaggaguucgcgagcggccggaaguccaucacccuggacauccugaccgagaucgccagccuccccacguaccuguccagccgcgccaagcuggcccucgacaacaucgugaugcugcacaccaccgagcggggcgggaaggccuaccagcacgcgcugaacgagcuccccgagucccuggagacccugaugcucguggcccugcugggcgccaugacggccgggaucuuccucuucuucaugcagggcaaggggaugggcaagcugagcaugggccugaucgcgaucgccgucgccuccgggcuccuguggguggccgagauccagccgcaguggaucgccgcgagcaucauccuggaguucuuccucauggugcugcugguccccgagcccgagaagcagcgcaccccccaggacaaccagcucaucuacgugauccugaccauccugaccaucaucgcccucguggccgccaacgagaugggccugaucgagaagacgaagaccgacuucggguucuaccaggucaaggccgagaccaccauccuggacguggaccuccgcccggcgagcgccuggacgcuguacgccguggccaccaccauccugacccccaugcuccggcacacgaucgagaacaccuccgccaaccugagccuggcggccaucgccaaccaggccgccguccucaugggccuggggaagggcuggccccugcaccgcauggaccucggcgugccccugcuggcgauggggugcuacucccaggugaacccgaccacccucacggccagccuggucaugcugcucgugcacuacgccaucaucggccccgggcugcaggccaaggcgacccgggaggcccagaagcgcaccgccgccggcaucaugaagaaccccaccguggacggcaucacggucaucgaccuggagcccaucuccuacgacccgaaguucgagaagcagcucgggcaggugaugcugcuggugcucugcgucggccagcugcugcucaugcggaccaccugggccuucugcgaggugcugacccuggcgacggggcccauccucacccugugggagggcaaccccgggcgcuucuggaacaccaccaucgccgugagcacggccaacaucuuccggggcuccuaccuggccggcgccgggcucgcguucagccugaucaagaacgcccagaccccccgccggggcaccgggaccaugggcgagacgcugggggagaaguggaagcgccagcucaacucccuggaccggaaggaguucgaggaguacaagcgcagcggcauccuggaggucgaccggaccgaggcccgcuccgcccucaaggacggcagcaagaucaaguacgccgugucccgggggaccagcaagauccgcuggaucguggagcggggcauggucaagccgaaggggaaggugguggaccugggcugcgggcgcggcggcugguccuacuacauggcgacccugaagaacgucaccgaggugaagggguacacgaagggcgggcccggccacgaggagcccauccccauggccaccuacggguggaaccucgugaagcugcacagcggcgucgacguguucuacaagccgaccgagcagguggacacccugcucugcgacaucggcgaguccagcuccaaccccacgaucgaggaggggcggacccugcgcguccugaagaugguggagcccuggcugagcagcaagcccgaguucugcaucaagguccucaacccguacaugcccaccgugaucgaggagcuggagaagcugcagcgccggcacggcgggucccucgugcgcugcccccugagccggaacuccacccacgagauguacugggucagcggcguguccggcaacaucgugagcuccgucaacacgaccagcaagaugcugcucaaccgcuucaccacccggcaccgcaagcccacguacgagaaggacgccgaccugggggccggcacccgguccgugagcaccgagaccgagaagccggacaugacgaucaucgggcgccggcugcagcgccuccaggaggagcacaaggagaccuggcacuacgaccacgagaaccccuaccggaccugggcguaccacggcuccuacgaggcccccagcaccggguccgccagcuccauggugaacggcgucgugaagcugcugacgaagccgugggacgugguccccauggugacccagcucgccaugaccgacaccacgcccuucggccagcagcgcguguucaaggagaaggucgacacccggaccccccagccgaagcccgggacccagguggugaugacgaccaccgccaacuggcuguggacccugcucggccgcaagaagaacccccggcugugcacgcgcgaggaguucaucagcaagguccgguccaacgcggccaucggggccguguuccaggaggagcagggcuggaccagcgccuccgaggccgugaacgacagccgcuucugggagcuggucgacaaggagcgggcgcuccaccaggaggggaagugcgagagcugcguguacaacaugaugggcaagcgcgagaagaagcugggcgaguucgggcgggccaagggcucccgcgccaucugguacauguggcugggggcccgcuuccucgaguucgaggcccugggcuuccugaacgaggaccacugguucgggcgggagaacagcugguccggcguggagggcgaggggcuccaccgccugggcuacauccuggaggacaucgacaagaaggacggggaccucaucuacgcggacgacaccgccggcugggacacccggaucacggaggacgaccugcugaacgaggagcucaucaccgagcagaugaccccccaccacaagauccuggccaaggccaucuucaagcugaccuaccagaacaaggucgugaaggugcuccgcccgacccccaagggcgcggucauggacaucaucagccggaaggaccagcgcggguccggccagguggggacguacggccugaacaccuucaccaacauggaggugcagcugauccggcagauggaggccgagggggucaucacccgcgacgacaugcacaaccccaagggccucaaggagcggguggagaaguggcugaaggagugcggcguggaccgccugaagcggauggccaucagcggggacgacugcgucgugaagccccucgacgagcgcuucuccacgagccugcuguuccucaacgacaugggcaaggugcggaaggacaucccgcagugggagcccuccaagggguggaagaacuggcaggagguccccuucugcagccaccacuuccacaagaucuucaugaaggacggccgcucccugguggugcccugccggaaccaggacgagcugaucgggcgcgcccggaucagccagggcgccggcuggucccuccgcgagaccgcgugccuggggaaggccuacgcccagauguggagccugauguacuuccaccggcgcgaccuccgccuggccuccauggccaucugcagcgcggucccgaccgagugguuccccaccucccggacgaccuggagcauccacgcccaccaccaguggaugaccaccgaggacaugcugaagguguggaaccgcguguggaucgaggacaaccccaacaugaucgacaagacgcccguccacagcugggaggacaucccguaccucggcaagcgggaggaccuguggugcgggucccugaucggccucagcucccgcgccaccugggccaagaacauccacaccgccaucacccaggugcggaaccugaucgggaaggaggaguacguggacuacaugcccgcgaugcgccgguacagcgcccacuucgaguccgagggcguccuguga

SEQ ID NO: 10539 - RNA, 9867 nt, Artificial Sequence
  derived and/or modified CDS sequence (opt1) from DENV-4__KT026309__SS-prME
agcaccaucacccugcucugccugauccccacggugauggccuuccaccuguccacccgcgacggcgagccgcucaugaucgucgccaagcacgagcgggggcgcccccugcuguucaagaccaccgagggcaucaacaagugcacgcucaucgcgauggaccugggggagaugugcgaggacaccgugaccuacaagugcccccugcucgugaacaccgagcccgaggacaucgacugcuggugcaaccugacgagcaccugggucauguacggcaccugcacccaguccggggagcggcgccgggagaagcgcagcguggcccugacgccgcacuccggcaugggccucgagacccgggccgagaccuggaugagcuccgagggggccuggaagcacgcccagcgcguggagagcuggauccugcggaaccccggcuucgcgcugcucgccggguucauggccuacaugaucggccagaccgggauccagcgcacggucuucuucauccugaugaugcugguggcccccuccuacggcaugcggugcgugggcgucgggaaccgcgacuucguggagggcgugagcgggggcgcgugggucgaccucgugcuggagcacggcgggugcgugaccaccauggcccagggcaagcccacccuggacuucgagcucaucaagacgaccgccaaggaggucgcccugcugcggaccuacugcaucgaggccuccaucagcaacaucaccacggcgacccgcugcccgacccagggggagcccuaccucaaggaggagcaggaccagcaguacaucugccggcgcgacaugguggaccggggcugggggaacggcugcggccuguucgggaagggcgggguggucaccugcgccaaguucuccugccugggcaagaucacggggaaccucgugcagaucgagaaccuggaguacaccguggucgugaccgugcacaacggcgacacccacgccgucggcaacgacacgagcaaccacggggugaccgccaccaucaccccccgcucccccagcgucgaggugcagcugccggacuacggcgagcucacgcuggacugcgagccccgguccgggaucgacuucaacgagaugauccugaugaagaugaagaccaagaccuggcucgugcacaagcagugguuccuggaccugccccuccccuggaccaccggcgccgacacgcuggagguccacuggaaccacaaggagcgcauggugaccuucaaggugccgcacgcgaagcggcaggacgucaccgugcuggggagccaggagggcgccaugcacuccgcccucgccggcgccaccgagguggacagcggggacggcaaccacauguucgcggggcaccugaagugcaagguccgcauggagaagcugcgcaucaagggcaugagcuacacgaugugcuccggcaaguucagcaucgacaaggagauggccgagacccagcacgggaccaccguggugaaggucaaguacgagggcacgggggcccccugcaaggugcccaucgagauccgggacgugaacaaggagaaggucgugggccgcaucaucuccagcacccccuucgccgagaacaccaacuccgugaccaacaucgagcucgagccgcccuucggggacagcuacaucgucaucggcgugggcgacuccgcccugacgcugcacugguuccggaaggggagcuccaucggcaagauguucgagagcaccuaccgcggggcgaagcggauggccauccucggcgagaccgccugggacuucggguccgugggcggccugcugaccagccucgggaaggccguccaccagguguucggcuccguguacacgaccauguucgggggcgucagcuggauggugcgcauccugaucgggcugcuggugcucuggaucggcaccaacucccggaacaccagcauggcgauguccugcaucgccgucggcgggaucacgcuguuccugggcuucaccgugcacgccgacauggggugcguggucagcugguccggcaaggagcucaagugcgggagcggcaucuucgugaucgacaacgugcacaccuggaccgagcaguacaaguuccagcccgagagccccgcccgccuggccuccgcgauccugaacgcccacaaggagggcgucugcgggauccggagcacgacccgccucgagaacgugauguggaagcagaucaccaacgagcugaacuacgugcugugggagggcgggcacgaccucaccgucguggccggcgacgugaagggcguccuguccaaggggaagcgggcccuggccccgcccgugaacgaccucaaguacagcuggaagacguggggcaaggcgaagaucuucacccccgagacccgcaacuccaccuuccugguggacgggcccgacacgagcgagugcccgaacgagcggcgcgccuggaacuuccuggaggucgaggacuacggcuucgggauguucaccaccaacaucuggaugaaguuccgggagggcuccagcgaggugugcgaccaccgccucauguccgccgccaucaaggaccagaaggccgugcacgcggacaugggcuacuggaucgagagcuccaagaaccagaccuggcagaucgagaaggccagccugaucgaggucaagacgugccuguggcccaagacccacacccucugguccaacggggugcuggagagccagaugcugauccccaaggccuacgccggcccgaucucccagcacaacuaccggcagggguacgcgacccagaccgccggccccuggcaccucgggaagcuggagaucgacuucggcgagugccccggcacgaccgugaccguccaggaggacugcgaccaccgcgggcccagccugcggaccacgaccgccuccggcaagcucgugacccaguggugcugccgcagcugcaccaugccgccccugcgcuuccugggggaggacggcugcugguacgggauggagauccggccccucaacgagaaggaggagaacauggugaagagccaggucuccgccggccacggcacgagcgagaccuucuccauggggcugcugugccucacccuguucguggaggagugccugcgccggcgcgucacccggaagcacaugauccucgugguggucacgacccugugcgccaucauccugggcgggcucaccuggauggaccugcugcgcgcgcucaucaugcugggcgacaccaugagcggccggauggggggccagauccaccuggccaucauggccguguucaagaugucccccggguacgugcucggcaucuuccugcgcaagcugacgagccgggagaccgcccucauggucaucgggauggccaugaccaccgugcuguccaucccgcacgaccugauggaguucaucgacggcaucagccucggccugauccugcucaagauggugacgcacuucgacaacacccaggucgggacccuggcgcuggcccucaccuucaucaaguccacgaugccccuggugauggccuggcgcaccaucauggccgugcuguucgucgugacccucaucccccugugccggaccagcugccugcagaagcagucccacuggguggagaucacggcccucauccugggcgcgcaggcccugcccgucuaccucaugacccugaugaagggggccagcaagcgcuccuggccgcugaacgagggcaucauggccguggggcucgugagccugcugggcuccgcgcuccugaagaacgacgucccccuggccggccccaugguggccgggggccuccugcuggccgccuacgugaugagcggguccagcgcggaccucucccuggagaaggccgccaacguccagugggacgagauggccgacaucaccggcagcagccccaucaucgaggugaagcaggacgaggacggguccuucagcauccgggacguggaggagaccaacaugaucacgcugcucgucaagcuggcccugaucaccguguccggccucuacccgcuggcgauccccgugaccaugacccugugguacauguggcaggucaagacgcagcgcagcggcgcccucugggacgugcccucccccgccgccgcccagaaggcgacccugaccgaggggguguaccggaucaugcagcgcggccuguucgggaagacccaggucggcguggggauccacaccgagggcguguuccacacgauguggcacgucacccggggcagcgugaucugccacgaguccgggcgccucgagccgagcugggccgacgugcggaacgacaugaucuccuacggcgggggcuggcgccugggcgacaagugggacaaggaggaggacguccaggugcuggccaucgagcccgggaagaaccccaagcacgugcagaccaagcccggccucuucaagacccugacgggggagaucggcgccgucacccuggacuucaagccggggaccagcggcucccccaucaucaaccggaagggcaaggugaucgggcucuacggcaacgggguggucaccaagagcggcgacuacguguccgccaucacgcaggcggagcgcaucggggagcccgacuacgagguggacgaggacaucuuccgcaagaagcggcugaccaucauggaccugcacccgggcgccggcaagaccaagcgcauccugcccagcaucguccgggaggcccucaagcgccggcugcgcacccugauccucgcccccacgcgggugguggcggccgagauggaggaggcccugcgcgggcugcccauccgguaccagaccccggccgucaaguccgagcacaccggccgcgagaucguggaccucaugugccacgccaccuucacgacccggcugcugagcuccacccgcgugcccaacuacaaccucaucgucauggacgaggcgcacuucaccgaccccagcuccguggccgcccggggguacaucagcacgcgcgucgagaugggcgaggccgccgcgguguucaugaccgccacccccccggggaccacggaccccuucccccagagcaacucccccaucgaggacaucgagcgggagaucccggagcgcagcuggaacaccggcuucgacuggaucaccgacuaccagggcaagaccgugugguucguccccuccaucaaggccgggaacgacaucgccaacugccugcggaagagcggcaagaaggugauccagcugucccgcaagacguucgacaccgaguaccccaagaccaagcucaccgacugggacuucgugaucacgaccgacaucagcgagaugggggccaacuuccgggcgggccgcgucaucgacccccgccggugccugaagccggugauccugaccgacgggcccgagcgcgugauccucgccggccccauccccgucaccccggccuccgccgcgcagcggcgcggccggaucgggcgcaaccccgcccaggaggacgaccaguacguguucagcggcgacccccugcggaacgacgaggaccacgcccacuggacggaggccaagaugcugcucgacaacaucuacacccccgaggggaucaucccgacccuguucggccccgagcgcgagaagacccaggccaucgacggcgaguuccggcugcgcggggagcagcggaagacguucguggagcucaugcgccggggcgaccugcccgucuggcugucccacaagguggcgagcgccgggaucuccuacaaggaccgcgaguggugcuucaccggcgagcggaacaaccagauccucgaggagaacaucgagguggagaucuggacccgcgagggggagaagaagaagcugcggcccaaguggcuggacgcccgcgucuacgccgacccgauggcccucaaggacuucaaggaguucgcgagcggccggaaguccaucacccuggacauccugaccgagaucgccagccuccccacguaccuguccagccgcgccaagcuggcccucgacaacaucgugaugcugcacaccaccgagcggggcgggaaggccuaccagcacgcgcugaacgagcuccccgagucccuggagacccugaugcucguggcccugcugggcgccaugacggccgggaucuuccucuucuucaugcagggcaaggggaugggcaagcugagcaugggccugaucgcgaucgccgucgccuccgggcuccuguggguggccgagauccagccgcaguggaucgccgcgagcaucauccuggaguucuuccucauggugcugcugguccccgagcccgagaagcagcgcaccccccaggacaaccagcucaucuacgugauccugaccauccugaccaucaucgcccucguggccgccaacgagaugggccugaucgagaagacgaagaccgacuucggguucuaccaggucaaggccgagaccaccauccuggacguggaccuccgcccggcgagcgccuggacgcuguacgccguggccaccaccauccugacccccaugcuccggcacacgaucgagaacaccuccgccaaccugagccuggcggccaucgccaaccaggccgccguccucaugggccuggggaagggcuggccccugcaccgcauggaccucggcgugccccugcuggcgauggggugcuacucccaggugaacccgaccacccucacggccagccuggucaugcugcucgugcacuacgccaucaucggccccgggcugcaggccaaggcgacccgggaggcccagaagcgcaccgccgccggcaucaugaagaaccccaccguggacggcaucacggucaucgaccuggagcccaucuccuacgacccgaaguucgagaagcagcucgggcaggugaugcugcuggugcucugcgucggccagcugcugcucaugcggaccaccugggccuucugcgaggugcugacccuggcgacggggcccauccucacccugugggagggcaaccccgggcgcuucuggaacaccaccaucgccgugagcacggccaacaucuuccggggcuccuaccuggccggcgccgggcucgcguucagccugaucaagaacgcccagaccccccgccggggcaccgggaccaugggcgagacgcugggggagaaguggaagcgccagcucaacucccuggaccggaaggaguucgaggaguacaagcgcagcggcauccuggaggucgaccggaccgaggcccgcuccgcccucaaggacggcagcaagaucaaguacgccgugucccgggggaccagcaagauccgcuggaucguggagcggggcauggucaagccgaaggggaaggugguggaccugggcugcgggcgcggcggcugguccuacuacauggcgacccugaagaacgucaccgaggugaagggguacacgaagggcgggcccggccacgaggagcccauccccauggccaccuacggguggaaccucgugaagcugcacagcggcgucgacguguucuacaagccgaccgagcagguggacacccugcucugcgacaucggcgaguccagcuccaaccccacgaucgaggaggggcggacccugcgcguccugaagaugguggagcccuggcugagcagcaagcccgaguucugcaucaagguccucaacccguacaugcccaccgugaucgaggagcuggagaagcugcagcgccggcacggcgggucccucgugcgcugcccccugagccggaacuccacccacgagauguacugggucagcggcguguccggcaacaucgugagcuccgucaacacgaccagcaagaugcugcucaaccgcuucaccacccggcaccgcaagcccacguacgagaaggacgccgaccugggggccggcacccgguccgugagcaccgagaccgagaagccggacaugacgaucaucgggcgccggcugcagcgccuccaggaggagcacaaggagaccuggcacuacgaccacgagaaccccuaccggaccugggcguaccacggcuccuacgaggcccccagcaccggguccgccagcuccauggugaacggcgucgugaagcugcugacgaagccgugggacgugguccccauggugacccagcucgccaugaccgacaccacgcccuucggccagcagcgcguguucaaggagaaggucgacacccggaccccccagccgaagcccgggacccagguggugaugacgaccaccgccaacuggcuguggacccugcucggccgcaagaagaacccccggcugugcacgcgcgaggaguucaucagcaagguccgguccaacgcggccaucggggccguguuccaggaggagcagggcuggaccagcgccuccgaggccgugaacgacagccgcuucugggagcuggucgacaaggagcgggcgcuccaccaggaggggaagugcgagagcugcguguacaacaugaugggcaagcgcgagaagaagcugggcgaguucgggcgggccaagggcucccgcgccaucugguacauguggcugggggcccgcuuccucgaguucgaggcccugggcuuccugaacgaggaccacugguucgggcgggagaacagcugguccggcguggagggcgaggggcuccaccgccugggcuacauccuggaggacaucgacaagaaggacggggaccucaucuacgcggacgacaccgccggcugggacacccggaucacggaggacgaccugcugaacgaggagcucaucaccgagcagaugaccccccaccacaagauccuggccaaggccaucuucaagcugaccuaccagaacaaggucgugaaggugcuccgcccgacccccaagggcgcggucauggacaucaucagccggaaggaccagcgcggguccggccagguggggacguacggccugaacaccuucaccaacauggaggugcagcugauccggcagauggaggccgagggggucaucacccgcgacgacaugcacaaccccaagggccucaaggagcggguggagaaguggcugaaggagugcggcguggaccgccugaagcggauggccaucagcggggacgacugcgucgugaagccccucgacgagcgcuucuccacgagccugcuguuccucaacgacaugggcaaggugcggaaggacaucccgcagugggagcccuccaagggguggaagaacuggcaggagguccccuucugcagccaccacuuccacaagaucuucaugaaggacggccgcucccugguggugcccugccggaaccaggacgagcugaucgggcgcgcccggaucagccagggcgccggcuggucccuccgcgagaccgcgugccuggggaaggccuacgcccagauguggagccugauguacuuccaccggcgcgaccuccgccuggccuccauggccaucugcagcgcggucccgaccgagugguuccccaccucccggacgaccuggagcauccacgcccaccaccaguggaugaccaccgaggacaugcugaagguguggaaccgcguguggaucgaggacaaccccaacaugaucgacaagacgcccguccacagcugggaggacaucccguaccucggcaagcgggaggaccuguggugcgggucccugaucggccucagcucccgcgccaccugggccaagaacauccacaccgccaucacccaggugcggaaccugaucgggaaggaggaguacguggacuacaugcccgcgaugcgccgguacagcgcccacuucgaguccgagggcguccuguga

SEQ ID NO: 10540 - RNA, 9867 nt, Artificial Sequence
  derived and/or modified CDS sequence (opt1) from DENV-4__KF907503__SS-prME
agcaccaucacccugcucugccugauccccaccgugauggccuuccaccuguccacccgcgacggcgagccgcucaugaucguggccaagcacgagcgggggcgcccccugcuguucaagaccaccgagggcaucaacaagugcacccucaucgcgauggaccugggggagaugugcgaggacaccgugaccuacaagugcccccugcucgugaacaccgagcccgaggacaucgacugcuggugcaaccugaccagcaccugggugauguacgggaccugcacccaguccggggagcggcgccgggagaagcgcagcguggcccugaccccgcacuccggcaugggccucgagacccgggccgagaccuggaugagcuccgagggggccuggaagcacgcccagcgcguggagagcuggauccugcggaaccccggcuucgcgcugcucgccggguucauggccuacaugaucggccagaccgggauccagcgcaccguguucuucgugcugaugaugcugguggcccccuccuacggcaugcggugcgucggcguggggaaccgcgacuucguggagggcgucagcgggggcgcguggguggaccucgugcuggagcacggcgggugcgucaccaccauggcccagggcaagcccacccuggacuucgagcucaccaagaccaccgccaaggagguggcccugcugcggaccuacugcaucgaggccuccaucagcaacaucacgaccgcgacccgcugcccgacccagggggagcccuaccucaaggaggagcaggaccagcaguacaucugccggcgcgacguggucgaccggggcugggggaacggcugcggccuguucgggaagggcgggguggugacgugcgccaaguucuccugcagcggcaagaucaccgggaaccugguccagaucgagaaccucgaguacaccgugguggucaccgugcacaacggcgacacgcacgccgucggcaacgacaccuccaaccacggggugaccgccaugaucacgccccggagccccuccguggaggucaagcugccggacuacggcgagcugacgcucgacugcgagccccggagcgggaucgacuucaacgagaugauccugaugaagaugaagaagaagaccuggcuggugcacaagcagugguuccucgaccugccccugcccuggaccgccggcgcggacaccuccgaggugcacuggaacuacaaggagcgcauggucaccuucaaggugccgcacgccaagcggcaggacgugacgguccucgggagccaggagggcgccaugcacagcgcccuggccggcgcgaccgagguggacuccggggacggcaaccacauguucgccgggcaccugaagugcaaggugcgcauggagaagcuccgcaucaagggcaugagcuacaccaugugcuccggcaaguucagcaucgacaaggagauggccgagacccagcacgggacgaccgucgugaaggugaaguacgagggcgccggggcccccugcaagguccccaucgagauccgggacgugaacaaggagaagguggucggccgcaucaucuccagcacgccccuggcggagaacaccaacuccgugacgaacaucgagcuggagccgcccuucggggacagcuacaucgugaucggcgucggcaacuccgcccucacccugcacugguuccggaaggggagcuccaucggcaagauguucgagagcaccuaccgcggggccaagcggauggccauccugggcgagaccgcgugggacuucggguccgugggcggccucuucacgagccuggggaaggccgugcaccaggucuucggcuccguguacaccaccauguucgggggcgugagcuggaugauccgcauccugaucggguuccucguccuguggaucggcaccaacucccggaacacgagcauggccaugaccugcaucgccgugggcgggaucacccuguuccugggcuucaccgugcaggccgacauggggugcgucguguccuggagcggcaaggagcucaagugcgggagcggcaucuucguggucgacaacgugcacacguggaccgagcaguacaaguuccagcccgagucccccgcgcgccuggccagcgccauccugaacgcccacaaggacggcgugugcgggauccgguccaccacccgccucgagaacgucauguggaagcagaucacgaacgagcugaacuacgugcugugggagggcgggcacgaccucaccguggucgccggcgacgugaagggcgugcugaccaaggggaagcgggcgcugaccccgcccgucagcgaccucaaguacuccuggaagacguggggcaaggccaagaucuucacccccgaggcccgcaacagcaccuuccugaucgacgggcccgacaccuccgagugcccgaacgagcggcgcgccuggaacagccuggagguggaggacuacggcuucgggauguucacgaccaacaucuggaugaaguuccgggagggcuccagcgaggugugcgaccaccgccucauguccgccgcgaucaaggaccagaaggccguccacgccgacaugggcuacuggaucgagagcuccaagaaccagaccuggcagaucgagaaggccagccugaucgaggugaagaccugccuguggcccaagacgcacacccucugguccaacggggugcuggagagccagaugcugauccccaaguccuacgcgggcccguucagccagcacaacuaccggcagggguacgccacccagaccgucggccccuggcaccucgggaagcuggagaucgacuucggcgagugccccggcaccacggugaccauccaggaggacugcgaccaccgcgggcccagccugcggaccuccaccgccagcggcaagcucgugacgcaguggugcugccgcuccugcaccaugccgccccugcgcuuccugggggaggacggcugcugguacgggauggagauccggccccucagcgagaaggaggagaacauggucaagucccaggugaccgccggccagggcaccagcgagacguucuccauggggcugcugugccucacccuguucgucgaggagugccugcgccggcgcgugacccggaagcacaugauccucguggucgugaucacccugugcgccaucauccugggcgggcucacguggauggaccugcugcgcgcgcucaucaugcugggcgacaccaugagcggccggaucgggggccagauccaccuggccaucauggccguguucaagaugucccccggguacguccucggcguguuccugcgcaagcugaccagccgggagaccgcccucauggugaucgggauggccaugacgaccguccuguccaucccgcacgaccugauggagcucaucgacggcaucagccugggccugauccuccugaagaucgugacccaguucgacaacacccagguggggacgcuggcgcucucccugaccuucauccgcagcaccaugccccugaucauggccuggcggaccaucauggccguccucuucguggugacgcugaucccccugugccgcaccuccugccuccagaagcagagccacugggucgagaucaccgcccugauccugggcgcccaggcgcuccccguguaccugaugacccugaugaagggggccucccggcgcagcuggccgcucaacgagggcaucauggccguggggcuggucucccugcucggcagcgcccugcugaagaacgacgugccccucgcgggccccaugguggccgggggccugcugcucgccgccuacgucaugagcggguccagcgccgaccugucccuggagaaggcggccaacgugcagugggacgagauggccgacaucacgggcagcucccccaucaucgaggugaagcaggacgaggacgggagcuucuccauccgggacgucgaggagaccaacaugaucacccuccuggugaagcuggcccucaucaccgugagcggccuguacccgcuggccauccccgucacgaugacccucugguacauguggcaggucaagacccagcgcuccggcgcgcugugggacgugcccagccccgccgccacccagaaggccgcccuguccgagggggucuaccggaucaugcagcgcggccucuucgggaagacccaggugggcguggggauccacauggagggcgucuuccacaccauguggcacgugacccggggcagcgugaucugccacgagaccgggcgccuggagccguccugggcggacguccggaacgacaugaucagcuacggcgggggcuggcgccugggcgacaagugggacaaggaggaggacguccaggugcucgccaucgagcccgggaagaaccccaagcacguccagaccaagcccggccuguucaagacgcugaccggggagaucggcgccgugacccucgacuucaagccggggaccuccggcagccccaucaucaaccgcaagggcaaggugaucgggcuguacggcaacggggucgugacgaaguccggcgacuacgugagcgccaucacccaggccgagcggaucggggagcccgacuacgaggucgacgaggacaucuuccgcaagaagcggcugaccaucauggaccuccacccgggcgcgggcaagaccaagcgcauccugcccuccaucgugcgggaggcccugaagcgccggcugcgcacgcucauccuggcccccacccggguggucgccgcggagauggaggaggcccugcgcgggcuccccauccgguaccagaccccggccgucaagagcgagcacaccggccgcgagaucguggaccugaugugccacgccacgagcaccacccggcugcucuccagcacccgcguccccaacuacaaccugaucgugauggacgaggcccacuucacggaccccuccagcgucgcggcccggggguacaucuccacccgcguggagaugggcgaggccgccgccaucuucaugaccgcgacgcccccgggggccacggaccccuucccccagagcaacucccccaucgaggacaucgagcgggagaucccggagcgcagcuggaacaccggcuucgacuggaucaccgacuaccagggcaagaccgugugguucguccccuccaucaaggccgggaacgacaucgccaacugccugcgcaagagcggcaagaaggugauccagcucucccgcaagacguucgacaccgaguaccccaagaccaagcugaccgacugggacuucguggucacgaccgacaucagcgagaugggggccaacuuccgcgcgggccgggugaucgacccccgccggugccugaagccggugauccucaccgacgggcccgagcgcgucauccuggccggccccauccccgugaccccggccuccgccgcgcagcggcgcggccggaucgggcgcaaccccgcccaggaggacgaccaguacguguucagcggcgacccccugaagaacgacgaggaccacgcccacuggacggaggccaagaugcuccuggacaacaucuacacccccgaggggaucaucccgacccuguucggccccgagcgggagaagacccaggccaucgacggcgaguuccgccuccgcggggagcagcgcaagacguucgucgagcugaugcggcgcggcgaccugcccguguggcucuccuacaagguggcgagcgccgggaucuccuacaaggaccgggaguggugcuucaccggcgagcgcaacaaccagauccuggaggagaacauggaggucgagaucuggacccgggagggggagaagaagaagcugcgcccccgguggcucgacgcccgcguguacgccgacccgauggcccugaaggacuucaaggaguucgcgagcggccggaaguccaucacccuggacauccucacggagaucgccagccugcccaccuaccugagcucccgcgccaagcucgcccuggacaacaucgugaugcugcacaccaccgagcgcggcgggcgggccuaccagcacgcgcucaacgagcugcccgagagccuggagacccucaugcuggucgcccugcucggcgccaugacggccgggaucuuccuguucuucaugcagggcaaggggaucggcaagcuguccaugggccucaucaucaucgcgguggccagcgggcugcuguggguggccgagauccagccgcaguggaucgccgccuccaucauccucgaguucuuccugaugguccugcucauccccgagcccgagaagcagcgcacgccccaggacaaccagcugaucuacgugauccugaccauccucaccaucaucggccugaucgcggccaacgagauggggcugaucgagaagacgaagaccgacuucggcuucuaccaggugaagaccgagaccacgauccucgacgucgaccugcggccggccagcgccuggacccuguacgccguggcgaccaccauccucacgcccaugcugcgccacaccaucgagaacaccuccgccaaccugagccucgccgccaucgccaaccaggcggccgugcugauggggcugggcaagggcuggccccuccaccggauggaccugggggucccccugcucgccaugggcugcuacucccaggugaacccgaccacgcugaccgccagccuggugaugcucuccguccacuacgccaucaucgggcccggccugcaggcgaaggccacccgcgaggcccagaagcggaccgccgcgggcaucaugaagaaccccacgguggacgggaucaccgugaucgaccuggagcccaucagcuacgacccgaaguucgagaagcagcucggccaggucaugcugcuggugcucugcgccgggcagcugcugcucaugcgcaccaccugggccuucugcgaggugcugacgcuggccaccggccccauccucacccugugggaggggaaccccggccgguucuggaacaccacgaucgccgucuccaccgcgaacaucuuccgcggcagcuaccuggccggggccggccucgccuucucccugaucaagaacgcccagacgccccggcgcgggaccggcacgaccggggagacccugggcgagaaguggaagcggcagcucaacagccuggaccgcaaggaguucgaggaguacaagcgguccggcauccuggagguggaccgcaccgaggccaagagcgcccucaaggacggguccaagaucaagcacgccgugagccggggcagcuccaagauccgcuggaucgucgagcgggggauggugaagccgaagggcaagguggucgaccuggggugcggccgcggcggguggagcuacuacauggccacgcugaagaacgugaccgaggugaagggcuacaccaagggcggccccgggcacgaggagcccauccccauggccaccuacggcuggaaccucgucaagcugcacuccggcguggacguguucuacaagccgaccgagcaggucgacacgcugcucugcgacaucggggagagcuccagcaaccccaccaucgaggagggccgcacccugcgggugcugaagaugguggagcccuggcucuccagcaagcccgaguucugcaucaagguccugaacccguacaugcccaccgugaucgaggagcuggagaagcugcagcgcaagcacgggggcaaccucguccggugcccccugucccgcaacagcacgcacgagauguacuggguguccggcgcgagcgggaacaucguguccagcgucaacaccaccuccaagaugcugcucaaccgguucaccacgcgccaccggaagcccaccuacgagaaggacguggaccugggcgccgggacccgcagcguguccaccgagacggagaagccggacaugaccaucaucggccggcgccugcagcggcuccaggaggagcacaaggagaccuggcacuacgaccaggagaaccccuaccgcaccugggccuaccacgggagcuacgaggcccccuccacgggcagcgcgagcuccauggucaacggcguggugaagcugcugaccaagccgugggacgucauccccauggugacccagcucgccaugaccgacacgacccccuucgggcagcagcggguguucaaggagaaggucgacacccgcacgccccagccgaagcccggcacgcggauggugaugaccaccaccgccaacuggcugugggcccugcucgggaagaagaagaacccccgccugugcacgcgggaggaguucaucagcaaggugcgcuccaacgccgcgaucggcgccgucuuccaggaggagcagggguggaccagcgccuccgaggccgugaacgacagccgguucugggagcugguggacaaggagcgcgcccuccaccaggagggcaagugcgaguccugcgucuacaacaugaugggcaagcgggagaagaagcugggggaguucggccgcgcgaaggggagccgcgccaucugguacauguggcugggcgcccgguuccucgaguucgaggcccugggguuccugaacgaggaccacugguucggccgcgagaacuccuggagcggcguggagggggagggccuccaccggcugggguacauccuggaggagaucgacaagaaggacggcgaccucauguacgccgacgacaccgcgggcugggacacccgcaucacggaggacgaccugcagaacgaggagcugaucaccgagcagauggcgccccaccacaagauccucgccaaggccaucuucaagcugaccuaccagaacaagguggucaaggugcugcggccgacgccccgcggggcggugauggacaucaucucccggaaggaccagcggggcagcgggcaggucggcacguacgggcucaacaccuucaccaacauggaggugcagcugauccggcagauggaggccgagggcgugaucacccaggacgacaugcagaaccccaagggccugaaggagcgcgucgagaaguggcucaaggagugcgggguggaccggcugaagcgcauggccaucuccggcgacgacugcguggucaagccccuggacgagcgguucgggaccagccuccuguuccugaacgacaugggcaaggugcgcaaggacaucccgcagugggagcccuccaagggguggaagaacuggcaggaggugcccuucugcagccaccacuuccacaagaucuucaugaaggacggccggucccucgucgugcccugccgcaaccaggacgagcugaucggccgggcccgcaucagccagggggccggcuggagccugcgggagacggcgugccucgggaaggccuacgcccagauguggucccugauguacuuccaccgccgcgaccugcggcucgccagcauggccaucugcuccgcggugccgaccgagugguuccccaccagccgcaccacgugguccauccacgcccaccaccaguggaugaccaccgaggacaugcugaaggucuggaaccggguguggaucgaggacaaccccaacaugaccgacaagacgcccgugcacagcugggaggacaucccguaccugggcaagcgcgaggaccucuggugcgggucccugaucggccugagcucccgggccaccugggccaagaacauccacaccgccaucacccagguccgcaaccucaucggcaaggaggaguacguggacuacaugcccgugaugaagcgguacagcgcgcccuccgagagcgaggggguccuguga

SEQ ID NO: 10541 - RNA, 9867 nt, Artificial Sequence
  derived and/or modified CDS sequence (opt1) from DENV-4__AY947539__SS-prME
agcaccaugacccugcucugccugauccccaccgccauggccuuccaccuguccacccgcgacggcgagccccucaugaucguggcccggcacgagcgcgggcggccccugcuguucaagaccaccgagggcaucaacaagugcacgcucaucgccauggaccugggggagaugugcgaggacaccgucaccuacgagugcccccugcucgugaacaccgagcccgaggacaucgacugcuggugcaaccugacgagcgccugggugauguacgggaccugcacccaguccggggagcgccggcgcgagaagcggagcgucgcccugacgccccacuccggcaugggccucgagacccgcgccgagaccuggaugagcuccgagggggcguggaagcacgcccagcggguggagagcuggauccugcgcaaccccggcuucgcccugcucgccggguucauggcguacaugaucggccagaccgggauccagcggaccguguucuucguccugaugaugcugguggcccccuccuacggcaugcgcugcgugggcgucgggaaccgggacuucguggagggcgugagcgggggcgccugggucgaccucgugcuggagcacggcgggugcgugacgaccauggcccagggcaagcccacccuggacuucgagcucaucaagaccacggccaaggaggucgcgcugcugcgcaccuacugcaucgaggccuccaucagcaacaucaccaccgccacgcggugcccgacccagggggagcccuaccucaaggaggagcaggaccagcaguacaucugccgccgggacgugguggaccgcggcugggggaacggcugcggccuguucgggaagggcggggucgugaccugcgccaaguucuccugcagcggcaagaucaccgggaaccuggugcagaucgagaaccucgaguacacggucguggugaccguccacaacggcgacacccacgccgugggcaacgacauccccaaccacggggucaccgcgacgaucacgccccggucccccagcguggaggugaagcugcccgacuacggcgagcugacccucgacugcgagccccgcuccgggaucgacuucaacgagaugauccugaugaagaugaagaagaagaccuggcugguccacaagcagugguuccucgaccugccccugccgugggccgccggcgccgacacgagcgaggugcacuggaacuacaaggagcggauggugaccuucaaggucccccacgccaagcgccaggacgugaccgugcucgggucccaggagggcgcgaugcacagcgcccugaccggcgccaccgaggucgacagcggggacggcaaccacauguucgccgggcaccugaagugcaaggugcgcauggagaagcuccggaucaagggcauguccuacacgaugugcagcggcaaguucuccaucgacaaggagauggccgagacccagcacgggaccaccguggucaaggugaaguacgagggcgcgggggcccccugcaaggugcccaucgagauccgcgacgucaacaaggagaagguggugggccggaucaucagcuccacgccguucgccgaguacaccaacagcgucaccaacaucgagcuggagccgcccuucggggacuccuacaucgugaucggcgugggcgacagcgcccugacccuccacugguuccgcaagggguccagcaucggcaagaugcuggaguccacguaccgcggggcgaagcggauggccauccugggcgagaccgccugggacuucgggagcgucggcggccuccugaccucccuggggaaggccgugcaccagguguucggcagcgucuacaccacgauguucgggggcguguccuggauggugcggauccucaucggguuccugguccuguggaucggcaccaacagccgcaacaccuccauggccaugaccugcaucgcggugggcgggaucacgcuguuccucggcuucaccgugcacgccgacaccgggugcgccgucagcugguccggcaaggagcugaagugcgggagcggcaucuucgugaucgacaacgugcacaccuggacggagcaguacaaguuccagcccgagagcccggcccggcuggccuccgcgauccucaacgcccacgaggacggcgucugcgggauccgcagcaccacccggcuggagaacaucauguggaagcagaucaccaacgagcugaacuacgugcucugggagggcgggcacgaccugacgguggucgccggcgacgugaagggcgugcuguccaaggggaagcgcgcccucgcgccgcccgucaacgaccugaaguacagcuggaagaccuggggcaaggcgaagaucuucacccccgaggccaagaacuccaccuuccugaucgacgggccggacacgagcgagugccccaacgagcggcgcgccuggaacuuccucgagguggaggacuacggcuucgggauguucaccaccaacaucuggaugaaguuccgggagggcuccagcgaggugugcgaccaccgccugauguccgccgcgaucaaggaccagaaggccguccacgccgacaugggcuacuggaucgagagcuccaagaaccagaccuggcagaucgagaaggccagccugaucgaggugaagacgugccucuggcccaagacccacacccugugguccaacggggugcuggagagccagaugcucaucccgaaggccuacgcgggccccuucucccagcacaacuaccggcagggguacgccacccagacggucggccccuggcaccuggggaagcuggagaucgacuucggcgagugccccggcaccaccgugaccauccaggaggacugcgaccaccgcgggccgagccuccggaccacgaccgccuccggcaagcuggugacccaguggugcugccgcagcugcaccaugccgccccugcgcuuccucggggaggacggcugcugguacgggauggagauccggccccugagcgagaaggaggagaacauggucaagucccaggugagcgccggccagggcacguccgagaccuucagcauggggcugcucugccugacccuguucguggaggagugccuccgccggcgcgucacccggaagcacaugauccugguggucgugacgacccugugcgccaucauccucggcgggcugaccuggauggaccugcuccgcgcgcugaucaugcugggcgacaccauguccggccggaugggcgggcagauccaccucgccaucauggccguguucaagaugagcccgggguacguccugggcaucuuccugcgcaagcucacgucccgggagaccgcccugauggugaucgggauggccaugaccaccgugcugagcaucccccacgaccucauggaguucaucgacggcaucucccugggccugauccuccugaagauggucacgcacuucgacaacacccagguggggacccuggcgcucagccugaccuucauccgcuccacgaugccccuggugauggccuggcggaccaucauggccguccucuucguggugacccugaucccccugugccgcaccagcugccuccagaagcagucccacugggucgagaucacggcccugauccugggcgcgcaggcccucccgguguaccugaugacccugaugaagggggccagcaagcgguccuggccccucaacgagggcaucauggccguggggcuggucagccugcucggcuccgcccugcugaagaacgacgugccccucgcgggccccaugguggccgggggccugcugcucgccgccuacgucaugagcggguccagcgccgaccugagccuggagaaggcggccaacgugcagugggacgagauggccgacaucaccggcuccagcccgaucaucgaggugaagcaggacgaggacggguccuucagcauccgcgacaucgaggagaccaacaugaucacgcuccuggucaagcuggcccucaucaccguguccggccuguacccccuggccauccccgugaccaugacccucugguacauguggcaggucaagacgcagcggagcggcgcgcugugggacgugcccuccccggccgccgcccagaaggccacccugaccgaggggguguaccgcaucaugcagcggggccucuucgggaagacccaggucggcguggggauccacauggagggcguguuccacacgauguggcacgucacccgcggcagcgugaucugccacgagaccgggcggcuggagcccuccugggcggacgugcgcaacgacaugaucagcuacggcgggggcuggcggcugggcgacaagugggacaaggaggaggacguccaggugcucgccaucgagcccgggaagaaccccaagcacgugcagaccaagccgggccuguucaagacccugacgggggagaucggcgccgucacccucgacuucaagcccgggaccuccggcagccccaucaucaaccgcaagggcaaggugaucgggcuguacggcaacgggguggucaccaaguccggcgacuacgugagcgccaucacgcaggcggagcgcaccggggagccggacuacgagguggacgaggacaucuuccggaagaagcgccugaccaucauggaccuccaccccggcgccggcaagaccaagcggauccugcccuccaucguccgcgaggcccugaagcggcgccugcggacgcucauccuggcccccacccgcgugguggccgcggagauggaggaggcccugcgggggcucccgauccgcuaccagacccccgccgucaagagcgagcacaccggccgggagaucguggaccugaugugccacgccacguucaccacccgccugcucuccagcacccgggugcccaacuacaaccugaucgucauggacgaggcccacuucacggaccccuccagcguggcggcccgcggguacaucagcacccggguggagaugggcgaggccgccgccaucuucaugaccgcgaccccgcccggggccacggaccccuucccccaguccaacagcccgaucgaggacaucgagcgcgagauccccgagcgguccuggaacaccggcuucgacuggaucaccgacuaccagggcaagaccgucugguucgugcccagcaucaaggccgggaacgacaucgccaacugccugcgcaaguccggcaagaaggucauccagcucagccggaagacguucgacaccgaguaccccaagaccaagcugaccgacugggacuucguggugacgaccgacaucuccgagaugggggcgaacuuccgcgccggccgcgucaucgacccgcggcgcugccugaagcccgugaucagcaccgacgggcccgagcgggugauccucgccggccccaucccggucacccccgccuccgccgcgcagcgccggggccgcaucgggcggaaccccgcccaggaggacgaccaguacguguucagcggcgacccccugaagaacgacgaggaccacgcccacuggacggaggccaagaugcugcucgacaacaucuacaccccggaggggaucauccccacccuguucggccccgagcgcgagaagaaccaggccaucgacggcgaguuccggcugcgcggggagcagcggaagaccuucguggagcucaugcgccggggcgaccugcccgucuggcuguccuacaagguggcgagcgccgggaucuccuacaaggaccgcgaguggugcuucacgggcgagcggaacaaccagauccucgaggagaacauggagguggagaucuggacccgcgagggggagaagaagaagcugcggccgaaguggcuggacgcccgcgucuacgccgaccccauggcccucaaggacuucaaggaguucgcgagcggccggaaguccaucacccuggacauccugaccgagaucgccagccuccccacguaccuguccagccgcgccaagcuggcccucgacaacaucgugaugcugcacaccaccgagcggggcgggaaggcguaccagcacgcccugaacgagcucccggagucccuggagacccugaugcucguggcccugcugggcgccaugaccgccgggaucuuccucuucuucaugcagggcaaggggaucggcaagcugagcaugggccugaucgcgaucgccgucgccagcgggcuccuguggguggccgagauccagccccaguggaucgccgcguccaucauccuggaguucuuccucauggugcugcugauccccgagcccgagaagcagcgcacgccgcaggacaaccagcucaucuacgucauccugaccauccugaccaucaucggccucaucgccgccaacgagauggggcugaucgagaagaccaagacggacuucggcuucuaccaggugaagaccgagaccaccauccuggacguggaccuccgccccgccagcgccuggacgcuguacgcggucgccaccaccauccugacccccaugcuccggcacacgaucgagaacaccuccgccaaccugagccuggccgccaucgcgaaccaggccgccgugcucauggggcugggcaagggcuggccccugcaccgcauggaccucggggugccgcugcuggccaugggcugcuacucccaggucaaccccaccacccucaucgcgagccuggugaugcugcucgugcacuacgccaucaucgggcccggccugcaggccaaggccacgcgggaggcccagaagcgcaccgcggccggcaucaugaagaaccccaccgucgacgggaucaccgugaucgaccuggagccgaucuccuacgaccccaaguucgagaagcagcucggccaggugaugcugcugguccucugcgccgggcagcugcugcucaugcggacgaccugggccuucugcgaggugcugacccuggccaccggccccgugcucacgcugugggaggggaaccccggccgcuucuggaacaccaccaucgcggucagcaccgccaacaucuuccggggcuccuaccuggccggggccggccucgccuucagccugaucaagaacgcgcagacgccgcgccgggggaccggcaccaccggggagacgcugggcgagaaguggaagcgccagcucaacucccuggaccggaaggaguucgaggaguacaagcgcagcggcauccuggagguggaccggaccgaggccaaguccgcccucaaggacgggagcaagaucaagcacgccgugucccgcggcagcuccaagauccgguggaucgucgagcgcgggauggugaagcccaagggcaagguggucgaccuggggugcggccggggcggguggagcuacuacauggcgacccugaagaacgugaccgaggugaagggcuacacgaagggcgggcccgggcacgaggagcccaucccgauggccaccuacggcuggaaccucgucaagcugcacuccggcguggacguguucuacaagcccaccgagcaggucgacacccugcucugcgacaucggggagagcagcuccaaccccaccaucgaggagggccgcacgcugcgggugcugaagaugguggagcccuggcucagcuccaagccggaguucugcaucaagguccugaaccccuacaugcccaccgugaucgaggagcuggagaagcugcagcgcaagcacgggggcagccucgugcgcugcccccugucccggaacagcacccacgagauguacugggucuccggcgugagcgggaacaucgucuccagcgugaacaccacguccaagaugcugcucaaccgcuucaccacccggcaccgcaagccgaccuacgagaaggacguggaccugggcgccgggacgcggagcgucuccaccgagaccgagaagcccgacaugaccaucaucggccgccggcugcagcgccuccaggaggagcacaaggagacguggcacuacgaccaggagaaccccuaccggaccugggccuaccacgggagcuacgaggccccguccaccggcagcgcguccagcauggugaacggcguggucaagcugcugaccaagcccugggacgugauccccauggugacgcagcucgccaugaccgacaccacccccuucgggcagcagcgcgucuucaaggagaagguggacacgcggaccccgcagcccaagcccggcacccgcauggugaugaccacgaccgccaacuggcugugggcccugcucgggaagaagaagaacccccggcugugcacccgcgaggaguucaucuccaagguccggagcaacgccgcgaucggcgccguguuccaggaggagcagggguggaccagcgccuccgaggccgugaacgacagccgcuucugggagcuggucgacaaggagcgggcccuccaccaggagggcaagugcgaguccugcguguacaacaugaugggcaagcgcgagaagaagcugggggaguucggccgggcgaaggggagccgcgccaucugguacauguggcugggcgcccgguuccucgaguucgaggcccugggguuccugaacgaggaccacugguucggccgcgagaacuccuggagcggcguggagggggagggccuccaccgccugggguacauccuggaggacaucgacaagaaggacggcgaccucaucuacgcggacgacacggccggcugggacacccggaucaccgaggacgaccugcugaacgaggagcucaucaccgagcagauggccccgcaccacaagauccuggccaaggccaucuucaagcugacguaccagaacaaggucgugaaggugcuccgccccacccccaagggggcggucauggacaucaucucccggaaggaccagcgcggcagcggccaggugggcaccuacgggcugaacaccuucacgaacauggaggugcagcugauccggcagauggaggccgagggcgucaucacccaggacgacaugcacaaccccaagggccucaaggagcgcguggagaaguggcugaaggagugcgggguggaccggcugaagcgcauggccaucuccggcgacgacugcgucgugaagccgcucgacgagcgguucagcaccucccugcuguuccucaacgacauggggaaggugcgcaaggacaucccccagugggagcccagcaagggcuggaagaacuggcaggagguccccuucugcucccaccacuuccacaagaucuucaugaaggacgggcggagccugguggugccgugccgcaaccaggacgagcugaucggccgggcccgcaucucccagggcgccggguggagccuccgggagaccgcgugccugggcaaggccuacgcccagauguggucccugauguacuuccaccgccgggaccuccgccuggccagcauggccaucugcagcgcgguccccaccgagugguuccccacgucccggaccaccuggagcauccacgcccaccaccaguggaugaccacggaggacaugcugaagguguggaaccgcguguggaucgaggacaaccccaacaugaccgacaagaccccgguccacuccugggaggacauccccuaccucgggaagcgcgaggaccuguggugcggcagccugaucgggcucuccagccgggccaccugggccaagaacauccacacggccaucacccaggugcgcaaccugaucggcaaggaggaguacguggacuacaugcccgucaugaagcgguacuccgcgcccuucgagagcgagggcgugcuguga

SEQ ID NO: 10542 - RNA, 9879 nt, Artificial Sequence
  derived and/or modified CDS sequence (opt2) from DENV-1__AB608789__SS-prME
uccgucaccaugcuccucaugcucaugcccaccgcccucgccuuccaccucaccacccgcggcggcgagccccacaugaucgucaccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacaucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagcgcggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgucggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcauguccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccgucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgagggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccaccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggcgucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggcccccgagucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucuccuccuccgagcucgagacccccaaccucgccgagcgcguccucgacuggcucggcaaguacggcgucgagcgccucaagcgcauggccaucuccggcgacgacugcgucgucaagcccaucgacgaccgcuucgccaccgcccucaccgcccucaacgacgucggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10543 - RNA, 9879 nt, Artificial Sequence
  derived and/or modified CDS sequence (opt2) from DENV-1__AB608788__SS-prME
uccgucaccaugcuccucaugcuccuccccaccguccucgccuuccaccucaccacccgcggcggcgagccccacaugaucgucaccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccaccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgcgucaucaccgccaaccccaucgucaccgacaaggagaagcccgucaacaucgaggccgagccccccuucggcgaguccuacaucgucgucggcgccggcgagaaggcccucaagcucuccugguucaagaagggcuccaccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcuacgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucuccggcauccucgcccagggcaagaagaugauccgcccccagcccauggagcacaaguacuccuggaaguccuggggcaaggccaagaucaucggcgccgacguccagaacuccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcgucuggcccaagucccacacccucugguccaacggcguccucgaguccgagaugaucauccccaagaucuacggcggccccaucucccagcacaacuaccgccccggcuacuucacccagaccuccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccgcccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccaccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucaucgaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggcgccggccacgaggagcccauccccauggccaccuacggcuggaaccucgucaagcucuacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcacccccaaggccaagcagggcaccgcccaggucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccaccgccucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgagaacaugcucuccgucuggaaccgcgucuggaucgaggagaaccccuggauggaggacaagacccacgucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgacuccgaccccgagggcgcccucugguga

SEQ ID NO: 10544 - RNA, 9879 nt, Artificial Sequence
  derived and/or modified CDS sequence (opt2) from DENV-1__AB608786__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgucaucggcaccuccaucacccagaagggcaucaucuucauccuccucaugcucgucacccccucccucgccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucaucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagggcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10545 - RNA, 9879 nt, Artificial Sequence
  derived and/or modified CDS sequence (opt2) from DENV-1__AB608787__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggagcacaaguacuccuggaaguccuggggcaaggccaagaucaucggcgccgacguccagaacuccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucguccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaucaucgaggaggucaugcgcucccgcuggauccgcaagaugcucaugaccggcacccucggcgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaggccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagggcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcucaagggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucugguccuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccugggaggacguccccuaccucggcaagcgcgaggaccaguggugcggcucccucaucggccucaccgcccgccccaccugggccaccaacauccaggucgccaucaaccagguccgccgccucaucggcaacgagaacuaccucgacuacaugaccuccaugaagcgcuucaagaacgaguccgagcccgagggcgcccucugguga

SEQ ID NO: 10546 - RNA, 9879 nt, Artificial Sequence
  derived and/or modified CDS sequence (opt2) from DENV-1__HE795086__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgaguucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccuccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgcaaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcguccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggacggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaaguacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccggccgcguccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10547 - RNA, 9879 nt, Artificial Sequence
  derived and/or modified CDS sequence (opt2) from DENV-1__AB189120__SS-prME
uccgucaccaugcuccucaugcuccuccccaccguccucaccuuccaccucaccacccgcggcggcgagccccacaugaucgucuccaagcaggagcgcggcaagucccuccucuucaagaccuccgccggcgucaacaugugcacccucaucgccauggaccucggcgagcucugcgacgacaccaugaccuacaagugcccccgcaucaccgagaccgagcccgacgacgucgacugcuggugcaacgccaccgagaccugggucaccuacggcaccugcucccagaccggcgagcaccgccgcgacaagcgcuccgucgcccucgccccccacgucggccucggccucgagacccgcaccgagaccuggauguccuccgagggcgccuggcgccagauccagaaggucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggccgucguccucggcucccaggagggcgccaugcacaccgcccucaccggcgccaccgagauccagaccuccggcaccaccaccaucuucgccggccaccucaagugccgccucaagauggacaagcucacccucaagggcaucuccuacgucaugugcaccggcuccuucaagcucgagaaggaggucgccgagacccagcacggcaccguccucguccaggucaaguacgagggcaccgacgcccccugcaagauccccuucuccucccaggacgagaagggcgucacccagaacggccgccucgucaccgccaaccccaucgucaccgacaaggagaagcccgucaacaucgaggccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucuccggcauccucgcccagggcaagaagaccauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcgucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgucgucuuccuccuccucacccucggccagcucaccuggaacgaccucauccgccucugcaucauggucggcgccaacgccuccgacaacaugggcaugggcaccaccuaccucgcccucauggccaccuuccgcaugcgccccauguucgccgucggccuccucuuccgccgccucaccucccgcgagguccuccuccucaccgucggccucucccucgucgccuccgucgagcuccccaacucccucgaggagcucggcgacggccucgccaugggcaucaugauccucaagcuccucaccgacuuccagucccaccagcucugggccacccuccucucccucaccuucgucaagaccacccucucccuccacuacgccuggaagaccauggccaugauccucuccaucgucucccuccucccccucugccucuccaccaccucccagaagaccaccuggcuccccguccuccucggcucccucggcugcaagccccucaccauguuccucaucaccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccaaggucuccugggaggaggaggccgagcacuccggcgccucccacaacauccucgucgagauccaggacgacggcaccaugaagaucaaggacgaggagcgcgacgacaccaucaccauccuccucaaggccacccuccucgccaucuccggcgucuaccccauguccauccccgccacccucuucgucugguacuucuggcagaagaagaagcagcgcuccggcguccucugggacacccccuccccccccgaggucgagaaggccguccucgacgacggcaucuaccgcauccuccagcgcggccuccucggccgcucccaggucggcgucggcgucuuccaggagggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucguccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagaaggacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggcaaggccuaccgccacgccauggaggagcuccccgacaccaucgagaccaucaugcuccucgcccucaucgccguccucaccggcggcgucacccucuucuuccucuccggccgcggccucggcaagaccuccaucggccuccucugcgucauguccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgccgccgccgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucaucgaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccgccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccggccgcguccucgacuggcucgagaagcacggcaccgagcgccuccgccgcauggccaucuccggcgacgacugcgucgucaagcccaucgacgaccgcuucgccaccgcccucaccgcccucaacgacaugggcaagauccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10548 - RNA, 9879 nt, Artificial Sequence
  derived and/or modified CDS sequence (opt2) from DENV-1__AB189121__SS-prME
uccgucaccaugcucuucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgagaccugggucaccuacggcaccugcucccagaccggcgagcaccgccgcgacaagcgcuccgucgcccucgccccccacgucggccucggccucgagacccgcaccgagaccuggauguccuccgagggcgccuggcgccagauccagaaggucgagaccugggcccuccgccaccccggcuucaccgucauggcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacaccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaccgccaucaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcgucuccuacgucaugugcaccggcuccuucaagcucgagaaggaggucgccgagacccagcacggcaccguccucguccaggucaaguacgagggcaccgacgcccccugcaagauccccuucuccucccaggacgagaagggcgucauccagaacggccgccucaucaccgccaaccccaucgucaccgacaaggagaagcccgucaacaucgaggccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucuccggcauccucgcccagggcaagaagaugauccgcccccagcccauggagcacaaguacuccuggaaguccuggggcaaggccaagaucaucggcgccgacguccagaacaucaccuucaucaucgacggccccaacaccuccgagugccccgacaaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccgucucccagcacaacuaccgccccggcuacuucacccagaccgccggccccuggcaccucggcaagcucgagcucgacuucgaccucugcgagggcaccaccgucgucgucgacgagaacugcggcaaccgcggccccucccuccgcaccaccaccgucaccggcaagaccauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuuccuccuccucaccaugggccagcucaccuggaacgaccucauccgccucugcaucauggucggcgccaacgccuccgacaugaugggcaugggcaccaccuaccucgcccucauggccaccuuccgcaugcgccccauguucgccgucggccuccucuuccgccgccucaccucccgcgagguccuccuccucaccgucggccucucccucgucgccuccgucgagcuccccaacucccucgaggagcucggcgacggccucgccaugggcaucaugaugcucaagcuccucaccgacuuccagccccaccagcucugggccacccuccucucccucaccuucgucaagaccaccuucucccuccacuacgccuggaagaccauggccaugauccucuccaucgucucccuccucccccucugccucuccaccaccucccagaagaccaccuggcuccccguccuccucggcucccucggcugcaagccccucaccaugcuccucaucaccgagaacaagaucuggggccgccgcuccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggacgaggccgagcacuccggcgccucccacaacauccucgucgagguccaggacgacggcaccaugaagaucaaggacgaggagcgcgacgacacccucaccauccuccucaaggccacccuccucgccaucuccggcgucuaccccauguccauccccgccacccucuucgucugguacuucuggcagaagaagaagcagcgcuccggcguccucugggacacccccuccccccccgaggucgagcgcgccguccucgacaacggcaucuaccgcauccuccagcgcggccuccucggccgcucccaggucggcgucggcgucuuccaggagggcgucuuccacaccauguggcacgucacccgcggcgccguccucauguaccagggcaagcgccucgagcccuccugggccuccgucaagcgcgaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucguccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucguccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccccaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagaaggcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgccgccgccgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaucuacaagcgcuccggcaucaucgaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagaagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcgucuucgacuggcucgagaagcacggcaucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10549 - RNA, 9879 nt, Artificial Sequence
  derived and/or modified CDS sequence (opt2) from DENV-1__AB195673__SS-prME
uccgucaccaugcuccucaugcuccuccccaccgcccucaccuuccaccucaccacccgcggcggcgagccccacaugaucgucggcaagcaggagcgcggcaagucccuccucuucaagaccuccgccggcgucaacaugugcacccucaucgccauggaccucggcgagcucugcgacgacaccaugaccuacaagugcccccgcaucaccgagaccgagcccgacgacgucgacugcuggugcaacgccaccgagaccugggucaccuacggcaccugcucccagaccggcgagcaccgccgcgacaagcgcuccgucgcccucgccccccacgucggccucggccucgagacccgcaccgagaccuggauguccuccgagggcgccuggcgccagauccagaaggucgagaccugggcccuccgccaccccggcuucaccgucaucgcccucuuccucgcccacgucaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacaccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcaucuccuacgucaugugcaccggcuccuucaagcucgagaaggaggucgccgagacccagcacggcaccguccucguccaggucaaguacgagggcaccgacgcccccugcaagauccccuucuccucccaggacgagaagggcgucacccagaacggccgccucgucaccgccaaccccaucgucaccgacaaggagaagcccgucaacaucgaggccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcauccuccucaccuggcucggccucaacucccgcuccaccucccucuccaugaccugcaucgccgucggccucaucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucuccggcauccucgcccagggcaagaaguccauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuuccuccuccucaccaugggccagcucaccuggaacgaccucauccgccucugcaucauggucggcgccaacgccuccgacaacaugggcaugggcaccaccuaccucgcccucauggccaccuuccgcaugcgccccauguucgccgucggccuccucuuccgccgccucaccucccgcgagguccuccuccucaccgucggccucucccucgucgccuccgucgagcuccccaacucccucgaggagcucggcgacggccucgccaugggcaucaugauccucaagcuccucaccgacuuccagucccaccagcucugggccacccuccucucccucaccuucgucaagaccaccuucucccuccacuacgccuggaagaccauggccaugauccucuccaucgucucccucuucccccucugccucuccaccaccucccagaagaccaccuggcuccccguccuccucggcucccucggcugcaagccccucaccauguuccucaucaccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagauccaggacgacggcaccaugaagaucaaggacgaggagcgcgacgacaccaucaccauccuccucaaggccacccuccucgccaucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggagggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucguccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagaaggacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauguccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgccgccgccgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaucuacaagcgcuccggcaucgucgaggucgaccgcuccgaggccaaggagggccucaagcgcggcgagaccaucaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcucuacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccgccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacaugggcgcccagcucauccgccagauggaguccgagggcaucuucucccccuccgagcucgagacccccaaccucgccggccgcguccucgacuggcucgagaagcacggcaucgagcgccuccgccgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10550 - RNA, 9879 nt, Artificial Sequence
  derived and/or modified CDS sequence (opt2) from DENV-1__AB204803__SS-prME
uccgucaccaugcuccucaugcuccuccccaccguccucaccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgagaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagaaggucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacaccaacuucgucugccgccgcaccuucgucgaccgcggcuggggcaacggcugcggccucuucggcaagggcucccucaucaccugcgucaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcaccuccuacgucaugugcaccggccccuucaagcucgagaaggaggucgccgagacccagcacggcaccguccucguccaggucaaguacgagggcaccgacgcccccugcaagauccccuucuccucccaggacgagaagggcgucacccagaacggccgccucaucaccgccaaccccaucgucaccgacaaggagaagcccaucaacaucgaggccgagccccccuucggcgaguccuacaucgucgucggcgucggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccaugggcaagcucguccaccagaucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucuccggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugcuccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacucccgcgccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcagugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuuccuccuccucaccaugggccagcucaccuggaacgaccucauccgccucugcaucauggucggcgccaacgccuccgacaagaugggcaugggcaccaccuaccucgcccucauggccaccuuccgcaugcgccccauguucgccgucggccuccucuuccgcggccucaccucccgcgagguccuccuccucaccgucggccucucccucgucgccuccgucgagcuccccaacucccucgaggagcucggcgacggccucgccaugggcaucaugaugcucaagcuccucaccgacuuccagucccaccagcucugggccacccuccucucccucaccuucgucaagaccaccuucucccuccacuacgccuggaagaccauggccaugacccucuccaucgucucccucuucccccucugccucuccaccaccucccagaagaccaccuggcuccccguccuccucggcucccucggcugcaagccccucaccauguuccucaucaccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacaccaucaccauccuccucaaggccacccuccucgccaucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggagggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucguccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagaaggacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagaaggcccagaccgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucauguccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgccgccgccgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgagguccgccccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaaguccggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccggccgcguccucgacuggcucgagaagcacggcaucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcucccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10551 - RNA, 9879 nt, Artificial Sequence
  derived and/or modified CDS sequence (opt2) from DENV-1__LC016760__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuaccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccaucgccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccguccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccaucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagugcgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagaucuccggcggcaacauguacgccgacgacaccgccggcugggacacccgcaucaccgaggacgaccuccagaacgaggccaagaucaccgagaucauggagcccgagcacgcccagcucgccaaggccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggaugaaggacaagacccacaucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10552 - RNA, 9879 nt, Artificial Sequence
  derived and/or modified CDS sequence (opt2) from DENV-1__LC128301__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgagaccugggucaccuacggcaccugcucccagaccggcgagcaccgccgcgacaagcgcuccgucgcccucgccccccacgucggccucggccucgagacccgcaccgagaccuggauguccuccgagggcgccuggcgccagauccagaaggucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacaccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaccgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcgucuccuacgucaugugcaccggcuccuucaagcucgagaaggaggucgccgagacccagcacggcaccguccucguccaggucaaguacgagggcaccgacgcccccugcaagauccccuucuccucccaggacgagaagggcgucacccagaacggccgccucaucaccgccaaccccaucgucaccgacaaggagaagcccgucaacaucgaggccgagccccccuucggcgaguccuaccucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucauccaccagaucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucaacggcauccucgcccagggcaagaagaugauccgcccccagcccauggagcacaaguacuccuggaaguccuggggcaaggccaaggucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucacccgcgccuccuucaucgaggucaagaccugcaucuggcccaagucccacacccucugguccaacggcguccucgaguccgagaugaucauccccaagaccuacggcggccccaucucccagcacaacuaccgccccggcuacuucacccagaccgccggccccuggcaccucggcaagcucgagcucgacuucggccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucguccgcuccauggucuccgccggcuccggcgaggucgacuccuucucccucggccuccucugcaucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgacaagaugggcaugggcaccaccuaccucgcccucauggccaccuuccgcaugcgccccauguucgccgucggccuccucuuccgccgccucaccucccgcgagguccuccuccucaccgucggccucucccucgucgccuccgucgagcuccccaacucccucgaggagcucggcgacggccucgccaugggcaucaugaugcucaagcuccucaccgacuuccagucccaccagcucugggccgcccuccucucccucaccuucgucaagaccaccuucucccuccacuacgccuggaagaccauggccaugauccucuccaucaucucccucuucccccucugcauguccaccaccucccagaagaccaccuggcuccccguccuccucggcucccucggcugcaagccccucaccauguuccucaucaccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccaucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggcaagucccaggucggcgucggcgucuuccaggagggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucguccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccauggaggccuucccccaguccaacgccgccauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucguccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagucccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcucuacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagguccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccaugacccaccgcaagcccaccuacgagaaggacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuuccuccccuccgagcucgagacccccaaccucgccgagcgcguccucgacuggcucgagaagcacggcaccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10553 - RNA, 9879 nt, Artificial Sequence
  derived and/or modified CDS sequence (opt2) from DENV-1__LC011945__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuaccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccaucgccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggcuccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccguccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccaucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagugcgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagaucuccggcggcaacauguacgccgacgacaccgccggcugggacacccgcaucaccgaggacgaccuccagaacgaggccaagaucaccgagaucauggagcccgagcacgcccagcucgccaaggccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggaugaaggacaagacccacaucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10554 - RNA, 9879 nt, Artificial Sequence
  derived and/or modified CDS sequence (opt2) from DENV-1__LC011949__SS-prME
uccgucaccaugcuccucaugcucguccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcaccuccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacaccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccaucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaggccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuuccuccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10555 - RNA, 9879 nt, Artificial Sequence
  derived and/or modified CDS sequence (opt2) from DENV-1__HM469966__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaugaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucguccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggaucgccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccauccucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucuggaagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcucuacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaggccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10556 - RNA, 9879 nt, Artificial Sequence
  derived and/or modified CDS sequence (opt2) from DENV-1__JX669462__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgagaagcgcuccgucgcccucgccccccacgucggccucggccucgagacccgcaccgagaccuggauguccuccgagggcgccuggcgccagauccagcgcgucgagaccugggcccuccgccaccccggcuucaccgucaucgccuucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagcgcggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacggccagcgcgccuggaacaucugggaggucgaggacuacggcuucggcgucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuucggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccacccucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucgucaagaccacccucucccucgacuacgccuggaagaccaccgccaugguccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcgccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggcuacgucgccgccgagaaccaccagcacgccaccaugcucgacgucgaccuccaccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcgcccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccgccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10557 - RNA, 9879 nt, Artificial Sequence
  derived and/or modified CDS sequence (opt2) from DENV-1__JX669463__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgagaagcgcuccgucgcccucgccccccacgucggccucggccucgagacccgcaccgagaccuggauguccuccgagggcgccuggcgccagauccagcgcgucgagaccugggcccuccgccaccccggcuucaccgucaucgccuucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagcgcggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacggccagcgcgccuggaacaucugggaggucgaggacuacggcuucggcgucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuucggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccacccucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucgucaagaccacccucucccucgacuacgccuggaagaccaccgccaugguccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcgccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggcuacgucgccgccgagaaccaccagcacgccaccaugcucgacgucgaccuccaccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcgcccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccgccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10558 - RNA, 9879 nt, Artificial Sequence
  derived and/or modified CDS sequence (opt2) from DENV-1__JX669464__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgucggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagaaggucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccaggucaaguacgagggcaccgacgcccccugcaagauccccuuccucacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggccucuucaccuccgucggcaagcucauccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaacuacauccuccucgagaacgacaugaaguucaccgucgucgucggcgacgucaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacgaccagcgcgccuggaacaucugggaggucgaggacuacggcuucggcaucuucaccaccaacaucuggcucaagcuccgcgacucccacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagauggucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcuaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgagauggacuccuucucccucggcauccucugcgucuccauccucaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccgucggccucucccucgucgccuccgucgagcuccccaacucccucgaggagcucggcgacggccucgccaugggcaucaugaugcucaagcuccucaccgacuuccagccccaccagcucuggaccacccuccucucccucaccuucauccgcaccucccucucccucgacuacgccuggaagaccauggccauggcccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggcccaucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcaccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagauccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccacccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggagggccccgagcgcgucauccucgccggccccaugcccgucaccgucgccuccgccgcccagcgccgcggccgcaucggccgcaaccagaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucauggccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucaccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagaaguccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaaguccggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccaagaagguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10559 - RNA, 9879 nt, Artificial Sequence
  derived and/or modified CDS sequence (opt2) from DENV-1__JX669465__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgucggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagaaggucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccaggucaaguacgagggcaccgacgcccccugcaagauccccuuccucacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggccucuucaccuccgucggcaagcucauccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaacuacauccuccucgagaacgacaugaaguucaccgucgucgucggcgacgucaacggcauccucgcccagggcaagaagaugauccgcccccagcccauggagcacaaguacuccuggaaguccuggggcaaggccaagaucaucggcgccgacacccagaacaccaccuucaucaucgacggccccgacacccccgagugccccgacgaccagcgcgccuggaacaucugggaggucgaggacuacggcuucggcaucuucaccaccaacaucuggcucaagcuccgcgacucccacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagauggucauccccaagaccuacggcggccccaucucccagcacaacuaccgccccggcuacuucacccagaccgccggccccuggcaccucggcaagcucgagcucgacuucgaccucugcgagggcaccaccgucgucgucgacgagcacugcggcuaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgagauggacuccuucucccucggcauccucugcgucuccauccucaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccgucggccucucccucgucgccuccgucgagcuccccaacucccucgaggagcucggcgacggccucgccaugggcaucaugaugcucaagcuccucaccgacuuccagccccaccagcucuggaccacccuccucucccucaccuucauccgcaccucccucucccucgacuacgccuggaagaccauggccauggcccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggcccaucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcaccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccacccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggagggccccgagcgcgucauccucgccggccccaugcccgucaccgucgccuccgccgcccagcgccgcggccgcaucggccgcaaccagaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucauggccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucaccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagaaguccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaaguccggcaccgucauggacgucaucucccgccgcgaccagcgcggcuccggccaggucggcaccuacggccucaacaccuucaccaacauggagguccagcucauccgccagauggaguccgagggcaucuucucccccuccgagcucgagacccccaaccucgccaagaagguccucgacuggcucgagaagcacggcgccgagcgccucaagcgcauggccaucuccggcgacgacugcgucgucaagcccaucgacgaccgcuucgccaccgcccucaccgcccucaacgacaugggcaagauccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10560 - RNA, 9879 nt, Artificial Sequence
  derived and/or modified CDS sequence (opt2) from DENV-1__JX669466__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgagaagcgcuccgucgcccucgccccccacgucggccucggccucgagacccgcaccgagaccuggauguccuccgagggcgccuggcgccagauccagcgcgucgagaccugggcccuccgccaccccggcuucaccgucaucgccuucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccauccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagcgcggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgaccucggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacggccagcgcgccuggaacaucugggaggucgaggacuacggcuucggcgucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuucggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucgucaagaccacccucucccucgacuacgccuggaagaccaccgccaugguccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcgccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggcuacgucgccgccgagaaccaccagcacgccaccaugcucgacgucgaccuccaccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcgcccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccgccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10561 - RNA, 9879 nt, Artificial Sequence
  derived and/or modified CDS sequence (opt2) from DENV-1__JX669467__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagaaggucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcaccuccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggccgcgccugggaggagggcgucugcggcauccgcuccgccacccgccucgagaacaucauguggaagcagaucuccaacgagcucaaccacauccuccucgagaacgacaucaaguucaccgucgucgucggcaacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacgagcagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagauguacggcggccccaucucccagcacaacuaccgccccggcuacuucacccagaccgccggccccuggcaccucggcaagcucgagcucgacuucgaccucugcgagggcaccaccgucgucgucgacgagcacugcggcucccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgacaagaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucaucaagaccacccucucccucgacuacgccuggaagaccaccgccaccguccucuccaucgucucccucuucccccucugccucuccaccaccucccagaagaccaccuggcuccccguccuccucggcuccuucggcugcaagccccucaccauguuccucaucaccgagaacgagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcaccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccaccagcacgccaccaugcucgacgucgaccuccaccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggaccucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuucuuccccuccgagcucgagucccccaaccucgccgagcgcguccucgacuggcucgagaagcacggcgccgagcgccucaagcgcauggccaucuccggcgacgacugcgucgucaagcccaucgacgaccgcuucgccaccgcccucaucgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10562 - RNA, 9879 nt, Artificial Sequence
  derived and/or modified CDS sequence (opt2) from DENV-1__HM469967__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccaaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgagaucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaggccggcaacgacaucgccaacugccuccgcaagaacggcaagcgcgucauccagcucucccgcaagaccuucgacaccgaguaccagaagaccaagaacuccgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcgucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucuggaagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcucaagugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcaagaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagaagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10563 - RNA, 9879 nt, Artificial Sequence
  derived and/or modified CDS sequence (opt2) from DENV-1__JX669468__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagaaggucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcaccuccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcaacggcaucuucgucaccaacgagguccacaccuggaccgagcaguacaaguuccaggccgacucccccaagcgccucuccgccgccaucggccgcgccugggaggagggcgucugcggcauccgcuccgccacccgccucgagaacaucauguggaagcagaucuccaacgagcucaaccacauccuccucgagaacgacaucaaguucaccgucgucgucggcaacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacgagcagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagauguacggcggccccaucucccagcacaacuaccgccccggcuacuucacccagaccgccggccccuggcaccucggcaagcucgagcucgacuucgaccucugcgagggcaccaccgucgucgucgacgagcacugcggcucccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgacaagaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucaucaagaccacccucucccucgacuacgccuggaagaccaccgccaccguccucuccaucgucucccucuucccccucugccucuccaccaccucccagaagaccaccuggcuccccguccuccucggcuccuucggcugcaagccccucaccauguuccucaucaccgagaacgagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcaccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccaccagcacgccaccaugcucgacgucgaccuccaccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggaccucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuucuuccccuccgagcucgagucccccaaccucgccgagcgcguccucgacuggcucgagaagcacggcgccgagcgccucaagcgcauggccaucuccggcgacgacugcgucgucaagcccaucgacgaccgcuucgccaccgcccucaucgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10564 - RNA, 9879 nt, Artificial Sequence
  derived and/or modified CDS sequence (opt2) from DENV-1__JX669469__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagaaggucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucaaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcaccuccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggccgcgccugggaggagggcgucugcggcauccgcuccgccacccgccucgagaacaucauguggaagcagaucuccaacgagcucaaccacauccuccucgagaacgacaucaaguucaccgucgucgucggcaacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacgagcagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagauguacggcggccccaucucccagcacaacuaccgccccggcuacuucacccagaccgccggccccuggcaccucggcaagcucgagcucgacuucgaccucugcgagggcaccaccgucgucgucgacgagcacugcggcucccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggucccgcaagaugcucaugaccggcacccucgccgucuuccuccuccucaucauggcccagcucaccuggaacgaccucauccgccucugcaucauggucggcgccaacgccuccgacaagaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucaucaagaccacccucucccucgacuacgccuggaagaccaccgccaugguccucuccaucgucucccucuucccccucugccucuccaccaccucccagaagaccaccuggcuccccguccuccucggcuccuucggcugcaagccccucaccauguuccucaucaccgagaacgagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcaccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccaccagcacgccaccauccucgacgucgaccuccaccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggaccucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuucuuccccuccgagcucgagucccccaaccucgccgagcgcguccucgacuggcucgagaagcacggcgccgagcgccucaagcgcauggccaucuccggcgacgacugcgucgucaagcccaucgacgaccgcuucgccaccgcccucaucgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10565 - RNA, 9879 nt, Artificial Sequence
  derived and/or modified CDS sequence (opt2) from DENV-1__JX669470__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagaaggucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgucgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggccgcgccugggaggagggcgucugcggcauccgcuccgccacccgccucgagaacaucauguggaagcagaucuccaacgagcucaaccacauccuccucgagaacgacaucaaguucaccgucgucgucggcaacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacgagcagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagauguacggcggccccaucucccagcacaacuaccgccccggcuacuucacccagaccgccggccccuggcaccucggcaagcucgagcucgacuucgaccucugcgagggcaccaccgucgucgucgacgagcacugcggcucccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgacaagaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucaucaagaccacccucucccucgacuacgccuggaagaccaccgccaugguccucuccaucgucucccucuucccccucugccucuccaccaccucccagaagaccaccuggcuccccguccuccucggcuccuucggcugcaagccccucaccauguuccucaucaccgagaacgagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcaccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguaccucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccaccagcacgccaccaugcucgacgucgaccuccaccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggaccucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccgcaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuucuuccccuccgagcucgagucccccaaccucgccgagcgcguccucgacuggcucgagaagcacggcgccgagcgccucaagcgcauggccaucuccggcgacgacugcgucgucaagcccaucgacgaccgcuucgccaccgcccucaucgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10566 - RNA, 9879 nt, Artificial Sequence
  derived and/or modified CDS sequence (opt2) from DENV-1__JX669471__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagaaggucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcaccuccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggccgcgccugggaggagggcgucugcggcauccgcuccgccacccgccucgagaacaucauguggaagcagaucuccaacgagcucaaccacauccuccucgagaacgacaucaaguucaccgucgucgucggcaacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacgagcagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagauguacggcggccccaucucccagcacaacuaccgccccggcuacuucacccagaccgccggccccuggcaccucggcaagcucgagcucgacuucgaccucugcgagggcaccaccgucgucgucgacgagcacugcggcucccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgacaagaugggcaugggcaccaccuaccucgcccucauggccacccucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucaucaagaccacccucucccucgacuacgccuggaagaccaccgccaugguccucuccaucgucucccucuucccccucugccucuccaccaccucccagaagaccaccuggcuccccguccuccucggcuccuucggcugcaagccccucaccauguuccucaucaccgagaacgagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcaccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccguccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccaccagcacgccaccaugcucgacgucgaccuccaccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggaccucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgaccgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuucuuccccuccgagcucgagucccccaaccucgccgagcgcguccucgacuggcucgagaagcacggcgccgagcgccucaagcgcauggccaucuccggcgacgacugcgucgucaagcccaucgacgaccgcuucgccaccgcccucaucgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10567 - RNA, 9879 nt, Artificial Sequence
  derived and/or modified CDS sequence (opt2) from DENV-1__JX669472__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagaaggucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcaccuccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggccgcgccugggaggagggcgucugcggcauccgcuccgccacccgccucgagaacaucauguggaagcagaucuccaacgagcucaaccacauccuccucgagaacgacaugaaguucaccgucgucgucggcaacgccaacggcauccucgcccagggcaagaagaugaucaagccccagcccauggagcacaaguacuccuggaaguccuggggcaaggccaagaucaucggcgccgacauccagaacaccaccuucaucaucgacggccccgacacccccgagugccccgacgagcagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagauguacggcggccccaucucccagcacaacuaccgccccggcuacuucacccagaccgccggccccuggcaccucggcaagcucgagcucgacuucgaccucugcgagggcaccaccgucgucgucgacgagcacugcggcucccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgacaagaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucaucaagaccacccucucccucgacuacgccuggaagaccaccgccaccguccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcaccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccaccagcacgccaccaugcucgacgucgaccuccaccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggaccucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuucuuccccuccgagcucgagucccccaaccucgccgagcgcguccucgacuggcucgagaagcacggcgccgagcgccucaagcgcauggccaucuccggcgacgacugcgucgucaagcccaucgacgaccgcuucgccaccgcccucaucgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10568 - RNA, 9879 nt, Artificial Sequence
  derived and/or modified CDS sequence (opt2) from DENV-1__JX669473__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagaaggucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccuccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcaccuccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggccgcgccugggaggagggcgucugcggcauccgcuccgccacccgccucgagaacaucauguggaagcagaucuccaacgagcucaaccacauccuccucgagaacgacaugaaguucaccgucgucgucggcaacgccaacggcauccucgcccagggcaagaagaugaucaagccccagcccauggagcacaaguacuccuggaaguccuggggcaaggccaagaucaucggcgccgacauccagaacgccaccuucaucaucgacggccccgacacccccgagugccccgacgagcagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagauguacggcggccccaucucccagcacaacuaccgccccggcuacuucacccagaccgccggccccuggcaccucggcaagcucgagcucgacuucgaccucugcgagggcaccaccgucgucgucgacgagcacugcggcucccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgacaagaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucaucaagaccacccucucccucgacuacgccuggaagaccaccgccaccguccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcaccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccaccagcacgccaccaugcucgacgucgaccuccaccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggaccucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuucuuccccuccgagcucgagucccccaaccucgccgagcgcguccucgacuggcucgagaagcacggcgccgagcgccucaagcgcauggccaucuccggcgacgacugcgucgucaagcccaucgacgaccgcuucgccaccgcccucaucgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10569 - RNA, 9879 nt, Artificial Sequence
  derived and/or modified CDS sequence (opt2) from DENV-1__JX669474__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagaaggucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggccgcgccugggaggagggcgucugcggcauccgcuccgccacccgccucgagaacaucauguggaagcagaucuccaacgagcucaaccacauccuccucgagaacgacaugaaguucaccgucgucgucggcaacgccaacggcauccucgcccagggcaagaagaugaucaagccccagcccauggagcacaaguacuccuggaaguccuggggcaaggccaagaucaucggcgccgacauccagaacgccaccuucaucaucgacggccccgacacccccgagugccccgacgagcagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagauguacggcggccccaccucccagcacaacuaccgccccggcuacuucacccagaccgccggccccuggcaccucggcaagcucgagcucgacuucgaccucugcgagggcaccaccgucgucgucgacgagcacugcggcucccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgacaagaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucaucaagaccacccucucccucgacuacgccuggaagaccaccgccaccguccucuccaucgucucccucuucccccucugccucuccaccaccucccagaagaccaccuggcuccccguccuccucggcuccuucggcugcaagccccucaccauguuccucaucaccgagaacgagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcaccucccacaacauccucgucgagguccaggacgacggcaccaugaagaucaaggacgaggagcgcgacgacacccucaccauccuccucaaggccacccuccucgccaucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccaccagcacgccaccaugcucgacgucgaccuccaccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggaccucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuucuuccccuccgagcucgagucccccaaccucgccgagcgcguccucgacuggcucgagaagcacggcgccgagcgccucaagcgcauggccaucuccggcgacgacugcgucgucaagcccaucgacgaccgcuucgccaccgcccucaucgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10570 - RNA, 9879 nt, Artificial Sequence
  derived and/or modified CDS sequence (opt2) from DENV-1__JX669475__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagaaggucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcaccuccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaucaaguucaccgucgucgucggcaacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacgagcagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagauguacggcggccccaucucccagcacaacuaccgccccggcuacuucacccagaccgccggccccuggcaccucggcaagcucgagcucgacuucgaccucugcgagggcaccaccgucgucgucgacgagcacugcggcucccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgacaagaugggcaugggcaccaccuaccucgcccucauggccaccuucaagaugcgccccauguucgccgucggccucuccuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucaucaagaccacccucucccucgacuacgccuggaagaccaccgccaugguccucuccaucgucucccucuucccccucugccucuccaccaccucccagaagaccaccuggcuccccguccuccucggcuccuucggcugcaagccccucaccauguuccucaucaccgagaacgagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcaccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccaccagcacgccaccaugcucgacgucgaccuccaccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggaccucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuucuuccccuccgagcucgagucccccaaccucgccgagcgcguccucgacuggcucgagaagcacggcgccgagcgccucaagcgcauggccaucuccggcgacgacugcgucgucaagcccaucgacgaccgcuucgccaccgcccucaucgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10571 - RNA, 9879 nt, Artificial Sequence
  derived and/or modified CDS sequence (opt2) from DENV-1__JX669461__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgucggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagaaggucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccaggucaaguacgagggcaccgacgcccccugcaagauccccuuccucacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggccucuucaccuccgucggcaagcucauccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaacuacauccuccucgagaacgacaugaaguucaccgucgucgucggcgacgucaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacgaccagcgcgccuggaacaucugggaggucgaggacuacggcuucggcaucuucaccaccaacaucuggcucaagcuccgcgacucccacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagauggucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcuaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgagauggacuccuucucccucggcauccucugcgucuccauccucaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgacaagaugggcaugggcaccaccuaccucgcccucauggccacccucaagaugcgccccauguucgccgucggccuccucuuccgccgccucaccucccgcgagguccuccuccucaccgucggccucucccucgucgccuccgucgagcuccccaacucccucgaggagcucggcgacggccucgccaugggcaucaugaugcucaagcuccucaccgacuuccagccccaccagcucuggaccacccuccucucccucaccuucauccgcaccucccucucccucgacuacgccuggaagaccauggccauggcccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggcccaucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcaccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccacccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggagggccccgagcgcgucauccucgccggccccaugcccgucaccgucgccuccgccgcccagcgccgcggccgcaucggccgcaaccagaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucauggccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucaccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagaaguccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaaguccggcaccgucauggacgucaucucccgccgcgaccagcgcggcuccggccaggucggcaccuacggccucaacaccuucaccaacauggagguccagcucauccgccagauggaguccgagggcaucuucucccccuccgagcucgagacccccaaccucgccaagaagguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10572 - RNA, 9879 nt, Artificial Sequence
  derived and/or modified CDS sequence (opt2) from DENV-1__KF184975__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccgaggaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccaggucaaguacgagggcaccgacgcccccugcaagauccccuucuccauccaggacgagaagggcgucauccagaacggccgccucaucaccgccaaccccaucgucaccgacaaggagaagcccgucaacaucgagaccgagccccccuucggcgaguccuacaucgucgucggcgccggcgagaagacccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacgucauguggaagcagaucuccaacgagcucaaccacauccuccucgagaacgacaugaaguucaccgucgucgucggcgacgucaacggcauccucgcccagggcaagaagaugguccgcccccagcccauggagcacaaguacuccuggaaguccuggggcaaggccaagaucaucggcgccgacauccagaacaccaccuucaucaucgacggccccgacacccccgagugccccgacgaccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaccucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucguccgcuccauggucuccgccggcuccggcgaggucgacaacuucucccucggccuccucugcgucuccaucauggucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgacuuccagucccaccagcucuggaccacccuccucucccucaccuucgucaagaccacccucucccucgacuacgccuggaagaccauggccaugguccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccgucggcaucgccuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggccgagaaggccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgcgucgagcccuccugggccuccgucaagaaggaccucaucuccuacggcggcggcuggcgcuuccagggccucuggaacaccggcgaggagguccaggucaucgccgucgagcccggcaagaacccccgcaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaagaccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccauggaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggccgccucccccagcaccucacccucaaggcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaucauccucaccgucgccgccaacgagaugggccuccucgagaccaccaagaaggaccucggcaucggccacgucgccgccgaggaccaccagcacgccaccaugcucgacgucgaccuccgccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacaccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucaccgaggucgaccgcuccgaggccaaggagggccucaagcgcggcgagaccaccaagcacgccgucucccgcggcgccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaaguccggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcgcccucgacuggcucgagaagcacggcgucgagcgccucaagcgcauggccaucuccggcgacgacugcgucgucaagcccaccgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10573 - RNA, 9879 nt, Artificial Sequence
  derived and/or modified CDS sequence (opt2) from DENV-1__KT831765__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaaccaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuaccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggcaugcucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucgucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccaucaacaugaccucccgcaugcuccucaaccgcuucaccauggcccaccgcaagcccaccuacgagcgcgacgucgaccucggcgccggcacccgccacgucaccgucgagcccgaggucgccaaccucgacaucaucggccagcgcaucgagaacaucaagugcgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagaucuccggcggcaacauguacgccgacgacaccgccggcugggacacccgcaucaccgaggacgaccuccagaacgaggccaagaucaccgagaucauggagcccgagcacgcccagcucgccaaggccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10574 - RNA, 9879 nt, Artificial Sequence
  derived and/or modified CDS sequence (opt2) from DENV-1__KP188567__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgucggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagaaggucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccauccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccaggucaaguacgagggcaccgacgcccccugcaagauccccuuccucacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggccucuucaccuccgucggcaagcucauccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaacuacauccuccucgagaacgacaugaaguucaccgucgucgucggcgacgucaacggcauccucgcccagggcaagaagaugaucaagccccagcccauggagcacaaguacuccuggaaguccuggggcaaggccaagaucaucggcgccgacauccagaacaccaccuucaucaucgacggccccgacacccccgagugccccgacgaccagcgcgccuggaacaucugggaggucgaggacuacggcuucggcaucuucaccaccaacaucuggcucaagcuccgcgacucccacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagauggucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcuaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccauccucaucgaggaggucaugcgcucccgcuggucccgcaagaugcucaugaccggcacccucgccgucuuccuccuccucaucaugggccagcucaccuggaacgaccucauccgccucugcaucauggucggcgccaacgcccucgaccgcaugggcaugggcaccaccuaccucgcccucauggccaccuucaagaugcgccccauguucgccgucggccuccucuuccgccgccucaccucccgcgagguccuccuccucaccgucggccucucccucgucgccuccgucgagcuccccuccucccucgaggagcucggcgacggccucgccaugggcaucaugaugcucaagcuccucaccgacuuccagccccaccagcucuggaccacccuccucucccucaccuucauccgcaccucccucucccucgacuacgccuggaagaccauggccauggcccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggcccaucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcaccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccacccaggagggcacccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggagggccccgagcgcgucauccucgccggccccaugcccgucaccgucgccuccgccgcccagcgccgcggccgcaucggccgcaaccagaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucauggccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucaccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagaaguccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaaguccggcaccgucauggacgucaucucccgccgcgaccagcgcggcuccggccaggucggcaccuacggccucaacaccuucaccaacauggagguccagcucauccgccagauggaguccgagggcaucuucucccccuccgagcucgagacccccaaccucgccaagaagguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgccgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10575 - RNA, 9879 nt, Artificial Sequence
  derived and/or modified CDS sequence (opt2) from DENV-1__KP188568__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgucggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagaaggucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccaggucaaguacgagggcaccgacgcccccugcaagauccccuuccucacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggccucuucaccuccgucggcaagcucauccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacgaccagcgcgccuggaacaucugggaggucgaggacuacggcuucggcaucuucaccaccaacaucuggcucaagcuccgcgacucccacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagauggucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcuaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgagauggacuccuucucccucggcauccucugcgucuccauccucaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccgucggccucucccucgucgccuccgucgagcuccccaacucccucgaggagcucggcgacggccucgccaugggcaucaugaugcucaagcuccucaccgacuuccagccccaccagcucuggaccacccuccucucccucaccuucauccgcaccucccucucccucgacuacgccuggaagaccauggccauggcccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggcccaucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcaccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccacccaggagggcccccuccccgagaucgaggacgaggucuucaagaagcgcaaccucaccaucauggaccuccaccccggcuccggcaagacccgccgcuaccuccccuccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgccauccaggacgaggagcgcgacauccccgagcgcuccuggaacaccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggagggccccgagcgcgucauccucgccggccccaugcccgucaccgucgccuccgccgcccagcgccgcggccgcaucggccgcaaccagaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucauggccuccuccgcccuccucugggucgccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucaccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucuccgucaugaagucccucggcggcggccgccgcggcaccggcgcccagggcgagacccucggcgagaaguggaagcgccagcucaaccagcucuccaaguccgaguucaacaccuacaagaaguccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaaguccggcaccgucauggacgucaucucccgccgcgaccagcgcggcuccggccaggucggcaccuacggccucaacaccuucaccaacauggagguccagcucauccgccagauggaguccgagggcaucuucucccccuccgagcucgagacccccaaccucgccaagaagguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10576 - RNA, 9879 nt, Artificial Sequence
  derived and/or modified CDS sequence (opt2) from DENV-1__KF971870__SS-prME
uccgucaccaugcuccucaugcucaugcccaccgcccucgccuuccaccucaccacccgcggcggcgagccccacaugauggucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccuccgccaucaaggacuccaaggccguccacgccgacaugggcuacuggaucgaguccgagaagaacgacaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaucggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgccgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuucccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcgagaagcuccgcccccgcuggcucggcgcccgcaccuacuccgacccccucgcccuccgcgacuucaaggaguucgccgccggccgccgcuccgucuccggcgaccucauccucgagaucggcaagcucccccagcaccucacccagcgcgcccagaacgcccucgacaaccucgucaugcuccacaacucccagcagggcggccgcgccuacacccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccgccucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucaucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaggccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucggcaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccaacugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10577 - RNA, 9879 nt, Artificial Sequence
  derived and/or modified CDS sequence (opt2) from DENV-1__KF971871__SS-prME
uccgucaccaugcuccucaugcucaugcccaccgcccucgccuuccaccucaccacccgcggcggcgagccccacaugauggucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgacaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaucggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgccgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuucccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucggcgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccgccucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucaucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaggccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucggcaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccaacugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10578 - RNA, 9879 nt, Artificial Sequence
  derived and/or modified CDS sequence (opt2) from DENV-1__KF971869__SS-prME
uccgucaccaugcuccucaugcucaugcccaccgcccucgccuuccaccucaccacccgcggcggcgagccccacaugauggucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgacaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaucggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgccgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuucccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccgccucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucaucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaggccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucggcaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccaacugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10579 - RNA, 9879 nt, Artificial Sequence
  derived and/or modified CDS sequence (opt2) from DENV-1__JN903578__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgucggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaaggucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccaggucaaguacgagggcaccgacgcccccugcaagauccccuuccucauccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucucccgcuucaagaagggcuccuccaucggcaagauguucgaggccaccgcccgcggcgcccgccgcauggccauccucggcgacaccgccugggacuucggcuccaucggcggcgucuucaccuccgucggcaagcucauccaccaggucuucggcaccgccuacggcguccucuucuccggcgucuccuggaccaugaagaucggcaucggcauccuccucaccuggcucggccucaacucccgcuccaccucccucuccaugaccugcaucaccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacgaccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgagaucaagaccugcaucuggcccaagucccacacccucugguccaacggcguccucgaguccgagaugaucauccccaagaucuacggcggccccaucucccagcacaaccaccgccccggcuacuucacccagaccgccggccccuggcaccucggcaagcucgagcucgacuucgacgucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggccuccucugcgucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgucuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgccgagcuccccaacucccucgaggagcucggcgacggccucgccaugggcaucaugaugcucaagcuccucaccgacuuccagucccaccagcucuggaccacccuccucucccucaccuucaucaagaccacccucucccucgacuacgccuggaagaccaucaccaugauccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcaccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagaaggacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacggcgaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucauggccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccaccaccacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcucccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaaguccggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccaagcgcguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccaccaugaagcgcuucaagaacgaguccgaccccgagggcgcccucugguga

SEQ ID NO: 10580 - RNA, 9879 nt, Artificial Sequence
  derived and/or modified CDS sequence (opt2) from DENV-1__JN903579__SS-prME
uccgucaccaugcuccucaugcuccuccccaccgcccucgccuuccaccucaccacccgcggcggcgagccccacaugaucgucggcaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggcgccagauccagaaggucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcgucuccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacaccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucacccagggcaagaagaugauccgcccccagcccauggagcacaaguacuccuggaaguccuggggcaaggccaagaucaucggcgccgacacccagaacaccaccuucaucaucgacggccccgacacccccgagugccccgacgaccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggccccgcucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucaaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggccuccucugcgucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgucuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgccgagcuccccaacucccucgaggagcucggcgacggccucgccaugggcaucaugaugcucaagcuccucaccgacuuccagucccaccagcucuggaccacccuccucucccucaccuucaucaagaccacccucucccucgacuacgccuggaagaccaucgccaugauccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagcgcgccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccaucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgccgccuccgccgcccagcgccgcggccgcaucggccgcaaccagaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggcucccucuucaugauccucaccgucgccgccaacgagaugggccuccucgagaccaccaagaaggaccucggcaucggccacgucgucgccgagaaccaccaccacgccaccacccucgacaucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaacaucgucaagcuccacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgagaucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgccccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccucuacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaaguccggcaccgucauggacgucaucucccgccgcgaccagcgcggcuccggccaggucggcaccuacggccucaacaccuucaccaacauggagguccagcucauccgccagauggaguccgagggcaucuucucccccuccgagcucgagaacuccaaccucgccgagcgcguccucgacuggcucgagaagcacggcgucgagcgccucaagcgcauggccaucuccggcgacgacugcgucgucaagcccaccgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucaacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuacuccgacuacaccaccuccaugaagcgcuucaagaacgaguccgaccccgagggcgcccucugguga

SEQ ID NO: 10581 - RNA, 9879 nt, Artificial Sequence
  derived and/or modified CDS sequence (opt2) from DENV-1__JN903580__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggcgccagauccagaaggucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcgucuccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcaacaccucccucuccaugaccugcaucgccgucggcauggucacccucuaccucggcgucaugguccaggccgacaccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucacccagggcaagaagaugauccgcccccagcccauggagcacaaguacuccuggaaguccuggggcaaggccaagaucaucggcgccgacacccagaacaccaccuucaucaucgacggccccgacacccccgagugccccgacgaccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggccccgcucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucaaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggccuccucugcgucuccaucaugaucgaggaggucaugaagucccgcuggucccgcaagaugcucaugaccggcacccucgccgucuucuuccuccucaucaugggccagcucaccuggaacgaccucauccgccucugcaucauggucggcgccaacgucuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgccgagcuccccaacucccucgaggagcucggcgacggccucgccaugggcaucaugaugcucaagcuccucaccgacuuccagucccaccagcucuggaccacccuccucucccucaccuucaucaagaccacccucucccucgacuacgccuggaagaccaucgccaugauccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagcgcgccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccaucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccgcaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgccgccuccgccgcccagcgccgcggccgcaucggccgcaaccagaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgucgccgagaaccaccaccacgccaccaugcucgacaucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcgacaccggcgcccagggcgagacccucggcgagaaguggaagcgccagcucaaccagcucuccaagcccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaacaucgucaagcuccacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgagaucgccaaccucgacaucaucggccagcgcauggagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgccccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccucuacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaaguccggcaccgucauggacgucaucucccgccgcgaccagcgcggcuccggccaggucggcaccuacggccucaacaccuucaccaacauggagguccagcucauccgccagauggaguccgagggcaucuucucccccuccgagcucgagaacuccaaccucgccgagcgcguccucgacuggcucgagaagcacggcgucgagcgccucaagcgcauggccaucuccggcgacgacugcgucgucaagcccaccgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucaacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuacuccgacuacaugaccuccaugaagcgcuucaagaacgaguccgaccccgagggcgcccucugguga

SEQ ID NO: 10582 - RNA, 9879 nt, Artificial Sequence
  derived and/or modified CDS sequence (opt2) from DENV-1__JN903581__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggcgccagauccagaaggucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcgucuccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcaacaccucccucuccaugaccugcaucgccgucggcauggucacccucuaccucggcgucaugguccaggccgacaccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucacccagggcaagaagaugauccgcccccagcccauggagcacaaguacuccuggaaguccuggggcaaggccaagaucaucggcgccgacacccagaacaccaccuucaucaucgacggccccgacacccccgagugccccgacgaccagcgcgccuggaacaucugggaggucgaggacuacggcuucggcaucuucaccaccaacaucuggcucaagcuccgcgacuccuacacccagaugugcgaccaccgccucauguccgccgucaucaaggacuccaaggccguccacgccgacaugggcuacuggaucgaguccgagaagaacgagaccuggaagcucgcccgcgccuccuucaucgaggucaagaccugcaucuggccccgcucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucaaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggaggaggaggagaaccucguccgcuccauggucuccgccggcuccggcgaggucgacuccuucucccucggccuccucugcgucuccaucaugaucgaggaggucaugaagucccgcuggucccgcaagaugcucaugaccggcacccucgccgucuucuuccuccucaucaugggccagcucaccuggaacgaccucauccgccucugcaucauggucggcgccaacgucuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgccgagcuccccaacucccucgaggagcucggcgacggccucgccaugggcaucaugaugcucaagcuccucgccgacuuccagucccaccagcucuggaccacccuccucucccucaccuucaucaagaccacccucucccucgacuacgccuggaagaccaucgccaugauccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagcgcgccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccaucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcgacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucgagcccgucauccucaaggacggccccgagcgcgucauccucgccggccccaugcccgucaccgccgccuccgccgcccagcgccgcggccgcaucggccgcaaccagaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagcgcgaccucggcaucggccacgucgucgccgagaaccaccaccacgccaccaugcucgacaucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgucaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaacaucgucaagcuccacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgagaucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgccccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccucuacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaaguccggcaccgucauggacgucaucucccgccgcgaccagcgcggcuccggccaggucggcaccuacggccucaacaccuucaccaacauggagguccagcucauccgccagauggaguccgagggcaucuucucccccuccgagcucgagaacuccaaccucgccgagcgcguccucgacuggcucgagaagcacggcgucgagcgccucaagcgcauggccaucuccggcgacgacugcgucgucaagcccaccgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucaacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuacuccgacuacaugaccuccaugaagcgcuucaagaacgaguccgaccccgagggcgcccucugguga

SEQ ID NO: 10583 - RNA, 9879 nt, Artificial Sequence
  derived and/or modified CDS sequence (opt2) from DENV-1__KX380796__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggcgccagaugcagaaggucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaccguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcgucuccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucaacggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucacccagggcaagaagaugauccgcccccagcccauggagcacaaguacuccuggaaguccuggggcaaggccaagaucaucggcgccgacacccagaacaccaccuucaucaucgacggccccgacacccccgagugccccgacgaccagcgcgccuggaacaucugggaggucgaggacuacggcuucggcgucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggccccgcucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggccuccucugcgucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgucuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgacuuccagccccaccagcucuggaccacccuccucucccucaccuucaucaagaccacccucucccucgacuacgccuggaagaccauggccaugguccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagcgcgccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgccgccuccgccgcccagcgccgcggccgcaucggccgcaaccagaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgucgccgagaaccaccaccacgccaccaugcucgacaucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggccgcuucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaacaucgucaagcuccacuccggccgcgacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgagaucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgccccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaaguccggcaccgucauggacgucaucucccgccgcgaccagcgcggcuccggccaggucggcaccuacggccucaacaccuucaccaacauggagguccagcucauccgccagauggaguccgagggcaucuucucccccuccgagcucgagaacuccaaccucgccgagcgcguccucgacuggcucgagaagcacggcgucgagcgccucaagcgcauggccaucuccggcgacgacugcgucgucaagcccaccgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucaacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10584 - RNA, 9879 nt, Artificial Sequence
  derived and/or modified CDS sequence (opt2) from DENV-1__KX380799__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggcgccagauccagaaggucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcgucuccuacgucaugugcaccggcuccuucaagcucgagaaggaggucgccgagacccagcacggcaccguccucguccaggucaaguacgagggcaccgacgcccccugcaagauccccaucuccacccaggacgagaagggcgucacccagaacggccgccucaucaccgccaaccccaucgucaccgacaaggagaagcccgucaacaucgagaccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucacccagggcaagaagaugauccgcccccagcccauggagcacaaguacuccuggaaguccuggggcaaggccaagaucaucggcgccgacacccagaacaccaccuucaucaucgacggccccgacacccccgagugccccgacgaccagcgcgccuggaacaucugggaggucgaggacuacggcuucggcgucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggccccgcucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucaaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggccuccucugcgucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgucuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgacuuccagucccaccagcucuggaccacccuccucucccucaccuucaucaagaccacccucucccucgacuacgccuggaagaccauggccaugguccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagcgcgccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgccgccuccgccgcccagcgccgcggccgcaucggccgcaaccagaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgucgccgagaaccaccaccacgccaccaugcucgacaucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggccgcuucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaacaucgucaagcuccacuccggccgcgacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgagaucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgccccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaaguccggcaccgucauggacgucaucucccgccgcgaccagcgcggcuccggccaggucggcaccuacggccucaacaccuucaccaacauggagguccagcucauccgccagauggaguccgagggcaucuucucccccuccgagcucgagaacuccaaccucgccgagcgcguccucgacuggcucgagaagcacggcgucgagcgccucaagcgcauggccaucuccggcgacgacugcgucgucaagcccaccgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucaacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10585 - RNA, 9879 nt, Artificial Sequence
  derived and/or modified CDS sequence (opt2) from DENV-1__KX380800__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggcgccagauccagaaggucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcgucuccuacgucaugugcaccggcuccuucaagcucgagaaggaggucgccgagacccagcacggcaccguccucguccaggucaaguacgagggcaccgacgcccccugcaagauccccaucuccacccaggacgagaagggcgucacccagaacggccgccucaucaccgccaaccccaucgucaccgacaaggagaagcccgucaacaucgagaccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucacccagggcaagaagaugauccgcccccagcccauggagcacaaguacuccuggaaguccuggggcaaggccaagaucaucggcgccgacacccagaacaccaccuucaucaucgacggccccgacacccccgagugccccgacgaccagcgcgccuggaacaucugggaggucgaggacuacggcuucggcgucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggccccgcucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucaaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggccuccucugcgucuccaucaugaucgaggaggucaugcgcucccgcuggucccgcaagaugcucaugaccggcacccucgccaucuucuuccuccucaucaugggccagcucaccuggaacgaccucauccgccucugcaucauggucggcgccaacgucuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgacuuccagucccaccagcucuggaccacccuccucucccucaccuucaucaagaccacccucucccucgacuacgccuggaagaccauggccaugguccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagcgcgccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgccgccuccgccgcccagcgccgcggccgcaucggccgcaaccagaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgucgccgagaaccaccaccacgccaccaugcucgacaucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaacaucgucaagcuccacuccggccgcgacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgagaucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgccccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaaguccggcaccgucauggacgucaucucccgccgcgaccagcgcggcuccggccaggucggcaccuacggccucaacaccuucaccaacauggagguccagcucauccgccagauggaguccgagggcaucuucucccccuccgagcucgagaacuccaaccucgccgagcgcguccucgacuggcucgagaagcacggcgucgagcgccucaagcgcauggccaucuccggcgacgacugcgucgucaagcccaccgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucaacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10586 - RNA, 9879 nt, Artificial Sequence
  derived and/or modified CDS sequence (opt2) from DENV-1__KX380802__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggcgccagauccagaaggucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagaugggcaagcucacccucaagggcgucuccuacgucaugugcaccggcuccuucaagcucgagaaggaggucgccgagacccagcacggcaccguccucguccaggucaaguacgagggcaccgacgcccccugcaagauccccaucuccacccaggacgagaagggcgucacccagaacggccgccucaucaccgccaaccccaucgucaccgacaaggagaagcccgucaacaucgagaccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucacccagggcaagaagaugauccgcccccagcccauggagcacaaguacuccuggaaguccuggggcaaggccaagaucaucggcgccgacacccagaacaccaccuucaucaucgacggccccgacacccccgagugccccgacgaccagcgcgccuggaacaucugggaggucgaggacuacggcuucggcgucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggccccgcucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucaaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggccuccucugcgucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgucuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgacuuccagucccaccagcucuggaccacccuccucucccucaccuucaucaagaccacccucucccucgacuacgccuggaagaccauggccaugguccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagcgcgccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgccgccuccgccgcccagcgccgcggccgcaucggccgcaaccagaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgucgccgagaaccaccaccacgccaccaugcucgacaucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaacaucgucaagcuccacuccggccgcgacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgagaucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgccccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaaguccggcaccgucauggacgucaucucccgccgcgaccagcgcggcuccggccaggucggcaccuacggccucaacaccuucaccaacauggagguccagcucauccgccagauggaguccgagggcaucuucucccccuccgagcucgagaacuccaaccucgccgagcgcguccucgacuggcucgagaagcacggcgucgagcgccucaagcgcauggccaucuccggcgacgacugcgucgucaagcccaccgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucaacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10587 - RNA, 9879 nt, Artificial Sequence
  derived and/or modified CDS sequence (opt2) from DENV-1__KX380797__SS-prME
uccgucaccguccuccucaugcuccuccccaccgcccucgccuuccaccucaccacccgcggcggcgagccccacaugaucgucuccaagcaggagcgcggcaagucccuccucuucaagaccuccaccggcgucaacaugugcacccucaucgccauggaccucggcgagcucugcgaggacaccaugaccuacaagugcccccgcaucaccgagaccgagcccgacgacgucgacugcuggugcaacgccaccgagaccugggucaccuacggcaccugcucccagaccggcgagcaccgccgcgacaagcgcuccgucgcccucgccccccacgucggccucggccucgagacccgcaccgagaccuggauguccuccgagggcgccuggcgccagauccagaaggucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacaccaacuucgucugccgccgcacccucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaccgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcgucuccuacgucaugugcaccggcuccuucaagcucgagaaggaggucgccgagacccagcacggcaccguccucguccaggucaaguacgagggcaccgacgcccccugcaagauccccuucaccucccaggacgagaagggcgucacccagaacggccgccucaucaccgccaaccccaucgucaccgacaaggagaagcccgucaacaucgaggccgagccccccuucggcgaguccuaccucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucauccaccagaucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucaacggcauccucgcccagggcaagaagaugauccgcccccagcccauggagcacaaguacuccuggaaguccuggggcaaggccaaggucaucggcgccgacguccagaacuccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucacccgcgccuccuucaucgaggucaagaccugcgucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucggccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgacaagaugggcaugggcaccaccuaccucgcccucauggccaccuuccgcaugcgccccauguucgccgucggccuccucuuccgccgccucaccucccgcgagguccuccuccgcuccgucggccucucccucgucgccuccgucgagcuccccaacucccucgaggagcucggcgacggccucgccaugggcaucaugaugcucaagcuccucaccgacuuccagucccaccagcucugggccgcccuccucucccucaccuucgucaagaccaccuucucccuccacuacgccuggaagaccauggccaugauccucuccaucgucucccucuucccccucugccucuccaccaccucccagaagaccaccuggcuccccguccuccucggcucccucggcugcaagccccucaccauguuccucaucaccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccaucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggcaagucccaggucggcgucggcgucuuccaggagggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucguccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccauggaggccuucccccaguccaacgccgccauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucguccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagucccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucaccaaguccgaguucaacaccuacaagcgcuccggcaucaucgaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcucuacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagguccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuuccuccccuccgagcucgagacccccaaccucgccgagcgcguccucgacuggcucgagaaguacggcaucgagcgccucaagcgcauggccaucuccggcgacgacugcgucgucaagcccgucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10588 - RNA, 9879 nt, Artificial Sequence
  derived and/or modified CDS sequence (opt2) from DENV-1__KX380805__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggcgccagauccagaaggucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcgucuccuacgucaugugcaccggcuccuucaagcucgagaaggaggucgccgagacccagcacggcaccguccucguccaggucaaguacgagggcaccgacgcccccugcaagauccccaucuccacccaggacgagaagggcgucacccagaacggccgccucaucaccgccaaccccaucgucaccgacaaggagaagcccgucaacaucgagaccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucacccagggcaagaagaugauccgcccccagcccauggagcacaaguacuccuggaaguccuggggcaaggccaagaucaucggcgccgacacccagaacaccaccuucaucaucgacggccccgacacccccgagugccccgacgaccagcgcgccuggaacaucugggaggucgaggacuacggcuucggcgucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggccccgcucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucaaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggccuccucuccgucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgucuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgacuuccagucccaccagcucuggaccacccuccucucccucaccuucaucaagaccacccucucccucgacuacgccuggaagaccauggccaugguccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagcgcgccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgccgccuccgccgcccagcgccgcggccgcaucggccgcaaccagaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgucgccgagaaccaccaccacgccaccaugcucgacaucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaacaucgucaagcuccacuccggccgcgacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgagaucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgccccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaaguccggcaccgucauggacgucaucucccgccgcgaccagcgcggcuccggccaggucggcaccuacggccucaacaccuucaccaacauggagguccagcucauccgccagauggaguccgagggcaucuucucccccuccgagcucgagaacuccaaccucgccgagcgcguccucgacuggcucgagaagcacggcgucgagcgccucaagcgcauggccaucuccggcgacgacugcgucgucaagcccaccgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucaacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10589 - RNA, 9879 nt, Artificial Sequence
  derived and/or modified CDS sequence (opt2) from DENV-1__KX380798__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccauccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucggcaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccacaaggagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10590 - RNA, 9879 nt, Artificial Sequence
  derived and/or modified CDS sequence (opt2) from DENV-1__KJ649286__SS-prME
uccgucaccaugcuccucaugcuccuccccaccguccucgccuuccaccucaccacccgcggcggcgagccccacaugaucgucaccaagcaggagcgcggcaagucccuccucuucaagaccuccaccggcgucaacaugugcacccucaucgccauggaccucggcgagcucugcgaggacaccaugaccuacaagugcccccgcaucaccgaggccgagcccgacgacaucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaccgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccaccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgucgagacccagcacggcaccguccucguccaggucaaguacgagggcaccgacgcccccugcaagauccccuuccucacccaggacgagaagggcgucacccagaacggccgcgucaucaccgccaaccccaucgucaccgacaaggagaagcccgucaacaucgaggccgagccccccuucggcgaguccuacaucgucgucggcgccggcgagaaggcccucaagcucuccugguucaagaagggcuccaccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucuccggcauccucgcccagggcaagaagaugauccgcccccagcccauggagcacaaguacuccuggaaguccuggggcaaggccaagaucaucggcgccgacguccagaacuccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcgucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccgcccuccucucccucaccuucaucaagaccaccugcucccuccacuacgccuggaagaccauggccaugguccucuccaucgucucccucuucccccucugcauguccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucgucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguacaagggcaagcgccucgagcccaccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccaguccgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucauggccuccuccaugcuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccaccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaaccccaugacccucaccgccgccguccucaugcucgucgcccacuacaccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucaucgaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggcgccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcacccccaaggccaagcgcggcaccgcccaggucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccaccgccucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggccucuucucccccuccgagcucgagacccccaaccucgccgagcgcguccucaacuggcucggcaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgagaacaugcucuccgucuggaaccgcgucuggaucgaggagaaccccuggauggaggacaagacccacgucuccuccugggaggacguccccuaccucggcaagcgcgaggaccaguggugcggcucccucaucggccucaccgcccgcgccaccugggccaccaacauccaggucgccaucaaccagguccgcaagcucaucggcaacgagaacuaccucgacuacaugaccuccaugaagcgcuucaagaacgacuccgaccccgagggcgcccucugguga

SEQ ID NO: 10591 - RNA, 9879 nt, Artificial Sequence
  derived and/or modified CDS sequence (opt2) from DENV-1__KF887994__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccauccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagaugcucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuuccuccuccucaucaucggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucauggccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucggcaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccugguacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccacaaggagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacuccuucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucgucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgccuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucaacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgcaagcucaucggcaacgagaacuaccucgacuacaugaccuccaugaagcgcuucaagaacgaguccgaccccgagggcgcccucugguga

SEQ ID NO: 10592 - RNA, 9879 nt, Artificial Sequence
  derived and/or modified CDS sequence (opt2) from DENV-1__JQ675358__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccagaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccauccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagcgcuccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcaccuccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacaaccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaccuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgccuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucaucaagaccacccucucccucgacuacgccuggaagaccaccgccauggcccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucucccuccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcaccucccacaacauccucgucgagguccaggacgacggcaccaugaagaucaaggacgaggagcgcgacgacacccucaccauccucgucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagccccgcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccaccagcacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacaccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaaguccgucggcggcggccgccgcggcaugggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccuccacaccuucaccaacauggagguccagcucauccgccagauggaguccgagggcaucuuccuccccuccgagcucgagacccccaaccucgccgagcgcguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10593 - RNA, 9879 nt, Artificial Sequence
  derived and/or modified CDS sequence (opt2) from DENV-1__FJ850070__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgucggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagaaggucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccaggucaaguacgagggcaccgacgcccccugcaagauccccuuccucacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggccucuucaccuccgucggcaagcucauccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaacuacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacgaccagcgcgccuggaacaucugggaggucgaggacuacggcuucggcaucuucaccaccaacaucuggcucaagcuccgcgacucccacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcuaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccauccucaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgacuuccagccccaccagcucuggaccacccuccucucccucaccuucauccgcaccucccucucccucgacuacgccuggaagaccauggccauggcccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggcccaucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcaccucccacaacauccucgucgagguccaggacgacggcaccaugaagaucaaggacgaggagcgcgacgacacccucaccauccuccucaaggccacccuccucgccgccuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucauggccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccaccaccacgccaccaugcucgacgucgaccuccaccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucaccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagaaguccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaaguccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaaguccggcaccgucauggacgucaucucccgccgcgaccagcgcggcuccggccaggucggcaccuacggccucaacaccuucaccaacauggagguccagcucauccgccagauggaguccgagggcaucuucucccccuccgagcucgagacccccaaccucgccaagcgcguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10594 - RNA, 9879 nt, Artificial Sequence
  derived and/or modified CDS sequence (opt2) from DENV-1__FJ850071__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgucggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagaaggucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccaggucaaguacgagggcaccgacgcccccugcaagauccccuuccucacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggccucuucaccuccgucggcaagcucauccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaacuacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacgaccagcgcgccuggaacaucugggaggucgaggacuacggcuucggcaucuucaccaccaacaucuggcucaagcuccgcgacucccacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcuaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccauccucaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgcaagcucaccucccgcgagguccuccuccucaccaucggccucucccucgucgccuccgucgagcuccccaacucccucgaggagcucggcgacggccucgccaugggcaucaugaugcucaagcuccucaccgacuuccagccccaccagcucuggaccacccuccucucccucaccuucauccgcaccucccucucccucgacuacgccuggaagaccauggccauggcccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggcccaucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcaccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucauggccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccaccaccacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucaccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagaaguccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaaguccggcaccgucauggacgucaucucccgccgcgaccagcgcggcuccggccaggucggcaccuacggccucaacaccuucaccaacauggagguccagcucauccgccagauggaguccgagggcaucuucucccccuccgagcucgagacccccaaccucgccaagcgcguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10595 - RNA, 9879 nt, Artificial Sequence
  derived and/or modified CDS sequence (opt2) from DENV-1__FJ850073__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagaaggucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcaccuccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggccgcgccugggaggagggcgucugcggcauccgcuccgccacccgccucgagaacaucauguggaagcagaucuccaacgagcucaaccacauccuccucgagaacgacaucaaguucaccgucgucgucggcaacgccgacggcauccucgcccagggcaagaagaugauccgcccccagcccauggagcacaaguacuccuggaaguccuggggcaaggccaagaucaucggcgccgacauccagaacaccaccuucaucaucgacggccccgacacccucgagugccccgacgagcagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagauguacggcggccccgucucccagcacaacuaccgccccggcuacuucacccagaccgccggccccuggcaccucggcaagcucgagcucgacuucgaccucugcgagggcaccaccgucgucgucgacgagcacugcggcucccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcguccucugcgucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgacaagaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucaucaagaccacccucucccucgacuacgccuggaagaccaccgccaugguccucuccaucgucucccucuucccccucugccucuccaccaccucccagaagaccaccuggcuccccguccuccucggcuccuucggcugcaagccccucaccauguuccucaucaccgagaacgagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggucgagcacuccggcaccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucauggccguccucaccggcggcgucacccucuucuuccucuccggcaagggccucggcaagaccuccaucggccuccucugcgucauggccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccaccagcacgccaccaugcucgacgucgaccuccaccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggaccucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccgcaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuucuucuccuccgagcucgagucccccaaccucgccgagcgcguccucgacuggcucgagaagcacggcgccgagcgccucaagcgcauggccaucuccggcgacgacugcgucgucaagcccaucgacgaccgcuucgccaccgcccucaucgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacggcaacuaccucgacuacaugaccuccaugaagcgcuucaagaacgaguccgaccccgagggcgcccucugguga

SEQ ID NO: 10596 - RNA, 9879 nt, Artificial Sequence
  derived and/or modified CDS sequence (opt2) from DENV-1__FJ850075__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgucggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagaaggucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccaggucaaguacgagggcaccgacgcccccugcaagauccccuuccucacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggccucuucaccuccgucggcaagcucauccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaacuacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacgaccagcgcgccuggaacaucugggaggucgaggacuacggcuucggcaucuucaccaccaacaucuggcucaagcuccgcgacucccacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcuaccgcggccccucccuccgcaccaccaccgucaccggcaagaccauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccauccucaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgacuuccagccccaccagcucuggaccacccuccucucccucaccuucauccgcaccucccucucccucgacuacgccuggaagaccauggccauggcccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggcccaucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcaccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucauggccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccaccaccacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucaccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagaaguccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaaguccggcaccgucauggacgucaucucccgccgcgaccagcgcggcuccggccaggucggcaccuacggccucaacaccuucaccaacauggagguccagcucauccgccagauggaguccgagggcaucuucucccccuccgagcucgagacccccaaccucgccaagcgcguccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10597 - RNA, 9879 nt, Artificial Sequence
  derived and/or modified CDS sequence (opt2) from DENV-1__FJ850077__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgucggcgucaacaugugcacccucaucgccauggaccucggcgagcucugcgaggacaccaugaccuacaagugcccccgcaucaccgaggucgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagguccagaaggucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccaggucaaguacgagggcaccgacgcccccugcaagauccccuuccucacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggccucuucaccuccgucggcaagcucauccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaacuacauccuccucgagaacgacaugaaguucaccgucgucgucggcgacgccaacggcauccucacccagggcaagaagaugauccgcccccagcccauggagcacaaguacuccuggaaguccuggggcaaggccaagaucaucggcgccgacauccagaacaccaccuucaucaucgacggccccgacacccccgagugccccgacgaccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaccucccagcacaacuaccgccccggcuacuucacccagaccgccggccccuggcaccucggcaagcucgagcucgacuucgaccucugcgagggcaccaccgucgucgucgacgagcacugcggcuaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccauccucaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgcaagcucaccucccgcgagguccuccuccucaccaucggccucucccucgucgccuccgucgagcuccccaacucccucgaggagcucggcgacggccucgccaugggcaucaugaugcucaagcuccucaccgacuuccagccccaccagcucuggaccacccuccucucccucaccuucauccgcaccucccucucccucgacuacgccuggaagaccauggccauggcccucuccaucgucucccucuucccccucugccucuccaccaccucccagaagaccaccuggcuccccguccuccucggcuccuucggcugcaagccccucaccauguuccucaucaccgagaaccgcaucuggggccgcaaguccuggcccaucaacgagggcgucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcaccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucauggccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccaccaccacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccaccguccucaugcucgucgcccacuacgccaucaucggccccggccuccaggccaaggccacccgcgaggcccagaagcgcaccgccgccggcaucaugaagaaccccaccgucgacggcaucgucaccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagaaguccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaaguccggcaccgucauggacgucaucucccgccgcgaccagcgcggcuccggccaggucggcaccuacggccucaacaccuucaccaacauggagguccagcucauccgccagauggaguccgagggcaucuucucccccuccgagcucgagacccccaaccucgccaagcgcguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgacaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10598 - RNA, 9879 nt, Artificial Sequence
  derived and/or modified CDS sequence (opt2) from DENV-1__FJ850081__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgucggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagaaggucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccaggucaaguacgagggcaccgacgcccccugcaagauccccuuccucacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggccucuucaccuccgucggcaagcucauccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaacuacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacgaccagcgcgccuggaacaucugggaggucgaggacuacggcuucggcaucuucaccaccaacaucuggcucaagcuccgcgacucccacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcuaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccauccucaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgacuuccagccccaccagcucuggaccacccuccucucccucaccuucauccgcaccucccucucccucgacuacgccuggaagaccauggccauggcccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggcccaucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcaccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgccgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucauggccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccaccaccacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucaccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagaaguccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaaguccggcaccgucauggacgucaucucccgccgcgaccagcgcggcuccggccaggucggcaccuacggccucaacaccuucaccaacauggagguccagcucauccgccagauggaguccgagggcaucuucucccccuccgagcucgagacccccaaccucgccaagcgcguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10599 - RNA, 9879 nt, Artificial Sequence
  derived and/or modified CDS sequence (opt2) from DENV-1__FJ850084__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgucggcgucaacaugugcacccucaucgccauggaccucggcgagcucugcgaggacaccaugaccuacaagugcccccgcaucaccgaggucgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagaaggucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccaggucaaguacgagggcaccgacgcccccugcaagauccccuuccucacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggccucuucaccuccgucggcaagcucauccaccaggucuucggcgccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaacuacauccuccucgagaacgacaugaaguucaccgucgucgucggcgacgccaacggcauccucacccagggcaagaagaugauccgcccccagcccauggagcacaaguacuccuggaaguccuggggcaaggccaagaucaucggcgccgacauccagaacaccaccuucaucaucgacggccccgacacccccgagugccccgacgaccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaccucccagcacaacuaccgccccggcuacuucacccagaccgccggccccuggcaccucggcaagcucgagcucgacuucgaccucugcgagggcaccaccgucgucgucgacgagcacugcggcuaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccgccgaggucgacuccuucucccucggcauccucugcgucuccauccucaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgcaagcucaccucccgcgagguccuccuccucaccaucggccucucccucgucgccuccgucgagcuccccaacucccucgaggagcucggcgacggccucgccaugggcaucaugaugcucaagcuccucaccgacuuccagccccaccagcucuggaccacccuccucucccucaccuucauccgcaccucccucucccucgacuacgccuggaagaccauggccauggcccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggcccaucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcaccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucauggccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccaccaccacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccaccguccucaugcucgucgcccacuacgccaucaucggccccggccuccaggccaaggccacccgcgaggcccagaagcgcaccgccgccggcaucaugaagaaccccaccgucgacggcaucgucaccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagaaguccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaaguccggcaccgucauggacgucaucucccgccgcgaccagcgcggcuccggccaggucggcaccuacggccucaacaccuucaccaacauggagguccagcucauccgccagauggaguccgagggcaucuucucccccuccgagcucgagacccccaaccucgccaagcgcguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgacaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10600 - RNA, 9879 nt, Artificial Sequence
  derived and/or modified CDS sequence (opt2) from DENV-1__FJ850087__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgucggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagaaggucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccaggucaaguacgagggcaccgacgcccccugcaagauccccuuccucacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggccucuucaccuccgucggcaagcucauccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaacuacauccuccucgagaacgacaugaaguucaccgucgucgucggcgacgucaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacgaccagcgcgccuggaacaucugggaggucgaggacuacggcuucggcaucuucaccaccaacaucuggcucaagcuccgcgacucccacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagauggucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcuaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccauccucaucgaggaggucaugcgcucccgcuggucccgcaagaugcucaugaccggcacccucgucgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccgucggccucucccucgucgccuccgucgagcuccccaacucccucgaggagcucggcgacggccucgccaugggcaucaugaugcucaagcuccucaccgacuuccagccccaccagcucuggaccacccuccucucccucaccuucauccgcaccucccucucccucgacuacgccuggaagaccauggccauggcccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggcccaucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcaccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcguccuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccacccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggagggccccgagcgcgucauccucgccggccccaugcccgucaccgucgccuccgccgcccagcgccgcggccgcaucggccgcaaccagaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucauggccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucaccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagaaguccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaaguccggcaccgucauggacgucaucucccgccgcgaccagcgcggcuccggccaggucggcaccuacggccucaacaccuucaccaacauggagguccagcucauccgccagauggaguccgagggcaucuucucccccuccgagcucgagacccccaaccucgccaagaagguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10601 - RNA, 9879 nt, Artificial Sequence
  derived and/or modified CDS sequence (opt2) from DENV-1__FJ850090__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgucggcgucaacaugugcacccucaucgccauggaccucggcgagcucugcgaggacaccaugaccuacaagugcccccgcaucaccgaggucgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagaaggucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccaggucaaguacgagggcaccgacgcccccugcaagauccccuuccucacccaggacgagaagggcgucauccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggccucuucaccuccgucggcaagcucauccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaacuacauccuccucgagaacgacaugaaguucaccgucgucgucggcgacgccaacggcauccucacccagggcaagaagaugauccgcccccagcccauggagcacaaguacuccuggaaguccuggggcaaggccaagaucaucggcgccgacauccagaacaccaccuucaucaucgacggccccgacacccccgagugccccgacgaccagcgcgccuggaacaucugggaggucgaggacuacggcuucggcaucuucaccaccaacaucuggcucaagcuccgcgacucccacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaccucccagcacaacuaccgccccggcuacuucacccagaccgccggccccuggcaccucggcaagcucgagcucgacuucgaccucugcgagggcaccaccgucgucgucgacgagcacugcggcuaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccauccucaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgcaagcucaccucccgcgagguccuccuccucaccaucggccucucccucgucgccuccgucgagcuccccaacucccucgaggagcucggcgacggccucgccaugggcaucaugaugcucaagcuccucaccgacuuccagccccaccagcucuggaccacccuccucucccucaccuucauccgcaccucccucucccucgacuacgccuggaagaccauggccauggcccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggcccaucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcaccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucauggccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccaccaccacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccaccguccucaugcucgucgcccacuacgccaucaucggccccggccuccaggccaaggccacccgcgaggcccagaagcgcaccgccgccggcaucaugaagaaccccaccgucgacggcaucgucaccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagaaguccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccgcccagaucauggaggucaccgccaaguggcucugggacuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaaguccggcaccgucauggacgucaucucccgccgcgaccagcgcggcuccggccaggucggcaccuacggccucaacaccuucaccaacauggagguccagcucauccgccagauggaguccgagggcaucuucucccccuccgagcucgagacccccaaccucgccaagcgcguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgacaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10602 - RNA, 9879 nt, Artificial Sequence
  derived and/or modified CDS sequence (opt2) from DENV-1__FJ850093__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacggccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccacccaccucgcccucauggccaccuucaagaugcgccccauguucgccgucggccuccucuuccgccgccucaccucccgcgagguccuccuccucaccaucggccucucccucauggccuccauggagcuccccaacucccucgaggagcucggcgacggccucgccaugggcaucaugaugcucaagcuccucaccgaguuccagccccaccagcucuggaccacccuccucucccucaccuucgucaagaccacccucucccucgacuacgccuggaagaccaccgccaugauccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcgccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagaccaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggcuacgucgccgccgagaaccaccagcacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagcgcgucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcucaagggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10603 - RNA, 9879 nt, Artificial Sequence
  derived and/or modified CDS sequence (opt2) from DENV-1__GU131863__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgucggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagaaggucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccaggucaaguacgagggcaccgacgcccccugcaagauccccuuccucacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggccucuucaccuccgucggcaagcucauccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaacuacauccuccucgagaacgacaugaaguucaccgucgucgucggcgacaucaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacgaccagcgcgccuggaacaucugggaggucgaggacuacggcuucggcaucuucaccaccaacaucuggcucaagcuccgcgacucccacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagauggucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcuaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccauccucaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccgucggccucucccucgucgccuccgucgagcuccccaacucccucgaggagcucggcgacggccucgccaugggcaucaugaugcucaagcuccucaccgacuuccagccccaccagcucuggaccacccuccucucccucaccuucauccgcaccucccucucccucgacuacgccuggaagaccauggccauggcccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggcccaucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcaccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccacccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggagggccccgagcgcgucauccucgccggccccaugcccgucaccgucgccuccgccgcccagcgccgcggccgcaucggccgcaaccagaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucauggccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucaccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagaaguccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaaguccggcaccgucauggacgucaucucccgccgcgaccagcgcggcuccggccaggucggcaccuacggccucaacaccuucaccaacauggagguccagcucauccgccagauggaguccgagggcaucuucucccccuccgagcucgagacccccaaccucgccaagaagguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10604 - RNA, 9879 nt, Artificial Sequence
  derived and/or modified CDS sequence (opt2) from DENV-1__GQ868559__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacggccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucgucaagaccacccucucccucgacuacgccuggaagaccaccgccaugguccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcgccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggcuacgucgccgccgagaaccaccagcacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggaggccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10605 - RNA, 9879 nt, Artificial Sequence
  derived and/or modified CDS sequence (opt2) from DENV-1__GQ868560__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacggccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucgucaagaccacccucucccucgacuacgccuggaagaccaccgccaugguccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcgccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccaucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggcuacgucgccgccgagaaccaccagcacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggaggccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuacaucgacuacaugaccuccaugaagcgcuucaagaacgaguccgaccccgagggcgcccucugguga

SEQ ID NO: 10606 - RNA, 9879 nt, Artificial Sequence
  derived and/or modified CDS sequence (opt2) from DENV-1__GQ868561__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgccuucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacggccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucgucaagaccacccucucccucgacuacgccuggaagaccaccgccaugguccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcgccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggcuacgucgccgccgagaaccaccagcacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccucccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaccaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10607 - RNA, 9879 nt, Artificial Sequence
  derived and/or modified CDS sequence (opt2) from DENV-1__GU131948__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacggccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagauccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucgucaagaccacccucucccucgacuacgccuggaagaccaccgccaugguccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcgccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaucuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccaucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggcuacgucgccgccgagaaccaccagcacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaccccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10608 - RNA, 9879 nt, Artificial Sequence
  derived and/or modified CDS sequence (opt2) from DENV-1__GQ868562__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccagcacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacggccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccacccaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucgucaagaccacccucucccucgacuacgccuggaagaccaccgccaugguccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcgccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgccacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggcuacgucgccgccgagaaccaccagcacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcucaagggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10609 - RNA, 9879 nt, Artificial Sequence
  derived and/or modified CDS sequence (opt2) from DENV-1__GQ868563__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacgccaccuucaucaucgacggccccgacacccccgagugccccgacggccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggucccgcaagaugcucaugaccggcacccucgccgucuuccuccuccucaucaugggccagcucaccuggaacgaccucacccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucgucaagaccacccucucccucgacuacgccuggaagaccaccgccaugguccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcgccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggccucuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggcuacgccgccgccgagaaccaccagcacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgagguccccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgaguggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10610 - RNA, 9879 nt, Artificial Sequence
  derived and/or modified CDS sequence (opt2) from DENV-1__GQ868564__SS-prME
uccgucaccaugcuccucaugcuccuccccaccgcccucgccuuccaccucaccacccgcggcggcgagccccacaugaucgucuccaagcaggagcgcggcaaggcccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacggccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagcgcgaggagaaccucguccgcuccauggucuccgccggcuccggcgaggucgacuccuucucccucggcauccucugcgucuccaucaugaucgaggaggucaugcgcucccgcuggucccgcaagaugcucaugaccggcacccucgccgucuuccuccuccucaucaugggccagcucaccuggaacgaccucacccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucgucaagaccacccucucccucgacuacgccuggaagaccaccgccaugguccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcacgaggccgagcacuccggcgccucccacaacauccucgucgagguccaggacgacggcaccaugaagaucaaggacgaggagcgcgacgacacccucaccauccuccucaaggccgcccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccaccagcacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgaguggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10611 - RNA, 9879 nt, Artificial Sequence
  derived and/or modified CDS sequence (opt2) from DENV-1__GQ868565__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacgccaccuucaucaucgacggccccgacacccccgagugccccgacggccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggucccgcaagaugcucaugaccggcacccucgccgucuuccuccuccucaucaugggccagcucaccuggaacgaccucacccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucgucaagaccacccucucccucgacuacgccuggaagaccaccgccaugguccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcgccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggccucuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggcuacgccgccgccgagaaccaccagcacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgaguggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10612 - RNA, 9879 nt, Artificial Sequence
  derived and/or modified CDS sequence (opt2) from DENV-1__GQ868568__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgucaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaucaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacacccagaacaccaccuucaucaucgacggccccgacacccccgagugccccgacggccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggucccgcaagaugcucaugaccggcacccucgccgucuuccuccuccucaucaugggccagcucaccuggaacgaccucacccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucgucaagaccacccucucccucgacuacgccuggaagaccaccgccaugguccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcgccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccgucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggcuacgucgccgccgagaaccaccagcacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgaguggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10613 - RNA, 9879 nt, Artificial Sequence
  derived and/or modified CDS sequence (opt2) from DENV-1__GQ868569__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucgccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacgccaccuucaucaucgacggccccgacacccccgagugccccgacggccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggucccgcaagaugcucaugaccggcacccucgccgucuuccuccuccucaucaugggccagcucaccuggaacgaccucacccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucgucaagaccacccucucccucgacuacgccuggaagaccaccgccaugguccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcgccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggccucuggaacaugggcgaggagguccaggucaucgccgucgagcccggcaagaacccccgcaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggcuacgccgccgccgagaaccaccagcacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgaguggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10614 - RNA, 9879 nt, Artificial Sequence
  derived and/or modified CDS sequence (opt2) from DENV-1__GQ868570__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaaggucggcaucggcauccuccucaccuggcucggccucaacucccgcuccaccucccucuccaugaccugcaucgccgucggcauggucacccucuaccucggcgucaugguccaggccgaccucggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgucacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacacccagaacaccaccuucaucaucgacggccccgacacccccgagugccccgacggccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucgucaagaccacccucucccucgacuacgccuggaagaccaccgccaugguccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcgccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgacaagcagcgcaccccccaggacaaccagcucgccuacgucgucaucggccuccucuucaugauccucgccgucgccgccaacgagaugggccuccucgagaccaccaagaaggaccucggcaucggcuacgucgccaccgagaaccaccagcacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaucuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucgagaagcacggcgccgagcgccucaagcgcauggccaucuccggcgacgacugcgucgucaagcccaucgacgaccgcuucgccgccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10615 - RNA, 9879 nt, Artificial Sequence
  derived and/or modified CDS sequence (opt2) from DENV-1__KJ189302__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgccuucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacggccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucgucaagaccacccucucccucgacuacgccuggaagaccaccgccaugguccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcgccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggcuacgucgccgccgagaaccaccagcacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccucccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10616 - RNA, 9879 nt, Artificial Sequence
  derived and/or modified CDS sequence (opt2) from DENV-1__KJ189303__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgucaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacacccagaacaccaccuucaucaucgacggccccgacacccccgagugccccgacggccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggucccgcaagaugcucaugaccggcacccucgccgucuuccuccuccucaucaugggccagcucaccuggaacgaccucacccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucgucaagaccacccucucccucgacuacgccuggaagaccaccgccaugguccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcgccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccgucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggcuacgucgccgccgagaaccaccagcacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgaguggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10617 - RNA, 9879 nt, Artificial Sequence
  derived and/or modified CDS sequence (opt2) from DENV-1__KR028435__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaucugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccaucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagggcggcaucuccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccaccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcucuacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucaucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaggccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10618 - RNA, 9879 nt, Artificial Sequence
  derived and/or modified CDS sequence (opt2) from DENV-1__JQ922548__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggcgccagauccagaaggucgagaccugggcccuccgccaccccggcuucaccgucaucgcccucuuccucgcccacaccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggcccgcaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccauguccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccaggccaagaagcaggaggucgucguccucggcucccaggagggcgccaugcacaccgcccucaccggcgccaccgagauccagaccuccggcaccaccaccauguucgccggccaccucaagugccgccucaagauggacaagcucacccucaagggcgccuccuacgucaugugcaccggccccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgccuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucacccagggcaagaagaugauccgcccccagcccauggagcacaaguacuccuggaaguccuggggcaaggccaagaucaucggcgccgacgcccagaacaccaccuucaucaucgacggccccgacacccccgagugccccgacgaccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucacccgcgccuccuucaucgaggucaagaccugcaccuggccccgcucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucaaccucugcgagggcaccaccgucgucgucgacgagcacugcggcaacggcggcgccucccucggcaccaccaccgucaccggcaagaucauccacgaguggugcugccgcuccugcacccuccccccccuccgcuuccucggcgaggacggcugcugguacggcauggagauccgccccgucaaggagaaggaggagaaccucuuccgcuccauggucuccgccggcuccggcgaggucgacuccuucucccucggccuccucugcgucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaucggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgacuuccagucccaccagcucuggaccacccuccucucccucaccuucaucaagaccacccucucccucgacuacgccuggaagaccaucgccaugguccucuccaucgucucccucuucccccucugccucuccaccaccucccagaagaccaccuggcuccccguccuccucggcuccuucggcuccaagccccucaccauguuccucaucaccgagaacaagaucuggggccgcaaguccuggccccucaacgagggcaucauggccgucggcaucgucuccauccuccucuccucccuccccaagaacgacgucccccucgccggcccccucaucgccggcggcaugcucaucgccugcuacgucaucuccggcuccuccgccgaccucucccucgagcgcgccgccgaggucuccugggaggaggaggccgagcacuccggcgccucccacaacauccucgucgagguccaggacgacggcaacaugaagaucaaggacgaggagcgcgacgacucccucaccauccuccucaaggccacccuccucgccgucuccggcgucuaccccauguccauccccgccacccucuucgucugguacuucuggcagaagaagaagcagcgcuccggcguccucugggacacccccuccccccccgaggucguccgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaacuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacucccgcaccgaccgcgucaucgacccccgccgcugccucaagcccgucauccucaaggacggccccgagcgcgucauccucgccggccccaugcccgucaccgccgccuccgccgcccagcgccgcggccgcaucggccgcaaccagaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucauggccuccuccguccuccucuggauggccuccgucgagccccacuggaucgccgccuccaucauccucgaguucuuccucaaggagcuccucauccccgacgccgacggccagcgcaccccccaggacaaccagcucgccuacgucgucaucggccuccucuucaugauccucaccgucgccgccaacgagaugggccuccucgagaccaccaagaagaaccucggcaucggccacgucgucgccgagaaccaccaccacgccaccaugcucgacaucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggccgccccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggccucaugaagaaccccaccgucgacggcaucgccgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcgccaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgagaucgccaaccucgacaucaucggccagcgcaucgagaacaucaagaacgagcacaaguccaccuggcacuacgacgaggacaaccccuacaagaccugggccuaccacggcaccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgccccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaaguccggcaccgucauggacgucaucucccgccgcgaccagcgcggcuccggccaggucggcaccuacggccucaacaccuucaccaacauggagguccagcucauccgccagauggaguccgagggcaucuucucccccuccgagcucgagaacuccaaccucgccgagcgcgcccucgacuggcucgagaagcacggcgucgagcgccucaagcgcauggccaucuccggcgacgacugcgucgucaagcccaccgacgaccgcuucgccaccgcccucaccgcccucaacgacaugggcaagguccgcaaggacaucccccagugcgagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucaacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggccgacguccccuaccucggcaagcgcgaggaccaguggugcggcucccucaucggccucgccgcccgcgccaccugggccaccaacauccaggucgcccucaaccagguccgccgccucaucggcaacgagaacuaccucgacuacaugaccuccaugaagcgcuucaagaacgaguccgaccccgagggcgcccucugguga

SEQ ID NO: 10619 - RNA, 9879 nt, Artificial Sequence
  derived and/or modified CDS sequence (opt2) from DENV-1__JQ922544__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccugcgagggcgccuggaagcagauccagaaggucgagaucugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgaguucgucgagggccucuccggcgccaccugggucgacgucguccucgagcacggcuccugccuccacaccauggcccagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccacccacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaucaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacgaccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgaggagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucguccgcuccauggucuccgccggcuccggcgaggucgacuccuucucccucggccuccucugcgucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgacuuccagucccaccagcucuggaccacccuccucucccucaccuucaucaagaccacccucucccucgacuacgccuggaagaccauggccaugguccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccgucggcaucgucuccauccuccucuccucccuccucaagaacgacgucccccucgccggcccccucaucgccggcggcaugcucaucuccuucuucgucaucuccggcuccuccgccgaccucucccucgagaaggccgccgaggucuccugggaggaggaggccgagcacuccggcaccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucaacaugggccagccccucaacaacgacgaggaccacgcccacuggaccgaggccaagaugcuccucgacaacaucaacacccccgagggcaucauccccgcccucuucgagcccgagcgcaagaaguccgccgccgucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagcgcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucauggccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccaccaccacgccaccaugcucgacgucgaccuccgccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucucccucauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaucuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccgcccagaucauggaggucaccgccaaguggcucuggggcuuccucucccgcaacaagaagccccgcaucugcacccgcgaggaguucacccgcaagguccgcuccaacgccgccaugggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaaguccggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacaagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaacaaggucuggaucgaggagaaccccuggauggaggacaagacccacgucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10620 - RNA, 9879 nt, Artificial Sequence
  derived and/or modified CDS sequence (opt2) from DENV-1__JQ922546__SS-prME
uccgucgccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaaguggccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagaaggucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaucaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccaggucaaguacgagggcaccgacgcccccugcaagauccccuucuccauccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacgucauguggaagcagaucuccaacgagcucaaccacauccuccucgagaacgacaugaaguucaccgucgucgucggcgacgucaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucguccgcuccauggucuccgccggcuccggcgaggucgacuccuucucccucggccuccucugcgucuccaucaugaucgaggaggucaugcgcucccgcuggucccgcaagaugcucaugaccggcacccucgccgucuucuuccuccucaucaugggccagcucaccuggaacgaccucuuccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgacuuccagucccaccagcucuggaccacccuccucucccucaccuucaucaagaccacccucucccucgacuacgccuggaagaccauggccaugguccucuccaucgucucccucuccccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccucccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcaucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaucuucaagacccccgagggcgaggucggcgccaucacccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaugaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggagggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgaccacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacaccgaccgccgcuggugcuucgacggcgagcgcaacaaccagguccucgaggagaacauggacgucgagaucuggauggaggagggcgagaagaagaagauccgcccccgcuggcucgagaucgagaaguacuccgacccccucgcccuccgcgaguucaaggaguucuccgccaagcgcaaguccguccucggcgaccucaagcucgagaucggcaagcucccccagcaccucaccaucaaggcccgcaacgcccucgacaaccucgucaugcuccacaacuccgagcagggcggcaaggccuaccgccacgccauggaggagcuccccgacaccaucgagacccucaugcgccucggccucaucgccgucaugaccggcggcgucacccucuucuuccucuccggcaagggccucggcaagaccuccaacggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgucgccgagaaccaccaccacgccaccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccccccagaucaugaagaaccagaucgucgacggcaucgucgccgucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccaccgucacccagaucgccaugaccgacaccacccccuucggccagcagcgcgucuucaaggagaaggucgacacccgcacccccaaggccaagcgcggcaccgcccagaucauggaggucaccgccaacuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaaguccggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucaacuggcucgagaagcacggcgucgagcgccucaagcgcauggccaucuccggcgacgacugcgucgucaagcccaccgacgaccgcuucgccaccgcccucaccgcccucaacgacaugggcaagguccgcaaggacaccccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccacggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggacguccccuaccucggcaagcgcgaggaccaguggugcggcuccaucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10621 - RNA, 9879 nt, Artificial Sequence
  derived and/or modified CDS sequence (opt2) from DENV-1__JQ922545__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggcgccagauccagaaggucgagaccugggcccuccgccaccccggcuucaccgucaucgcccucuuccucgcccacaccaucggcaccuccaucacccagaagggcaucaucuucauccuccucaugaccggcgcccccaucauggccaugcgcugcgucggcaucggcaaccgcgacuucgucgagggccucuccggcgcccccugggucgacgucguccucgagcacggcuccugccucuccaacauggccaagaacaagcccacccucgacaucgacuucuucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagauguccggcaccaccaccaucuucgccggccaccucaagugccgccucaagauggacaagcucacccucaagggcgucuccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccaccugccucgagaacaucauguggaagcagaucuccaacgagcucaaccacauccuccucgagaacgacaugaaguucaccgucgucgucggcgacgccaacggcauccucacccagggcaagaagaugauccgcccccagcccauggagcacaaguacuccuggaaguccuggggcaaggccaagaucaucggcgccgacauccagaacaccaccuucaucaucgacggccccgacacccccgagugccccgacgaccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggccccgcucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucguccgcuccauggucuccgccggcuccggcgaggucgacuccuucucccucggccuccucugcgucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgucuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgacuuccagucccaccagcucuggaccacccuccucucccucaccuucaucaagaccacccucucccucgacuacgccuggaagaccaucgccaugguccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggcccagcacuccggcgccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcuccgacaucgccaccguccucgagcgcucccgcgagcccgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccccaaggacggccccgagcgcgucauccucgccggccccaugcccgucaccgucgccuccgccgcccagcgccgcggccgcaucggccgcaaccagaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucgagaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucauggccuccuccguccuccucuggauggccuccgucgagccccacuggaucgccgccuccaucauccucgaguucauccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgucgccgagaaccaccaccacgccaccaugcucgacaucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgagaucgccaaccucgacaucaucggccagcgcaucgagaacaucaagaucggccacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgccccaagcgcggcaccgcccagaucauggaggucaccgccaaguggauguggggcuuccucuuccgcaaccgccccccccgcaucugcacccgcgacgaguucgcccgcaagguccgcuccuccaccgccaacggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgacuccuccaacgaggccaagaucaucgagcucaugcgccccgagcacgcccuccucgccaccuccaucuucaagcucaccuuccagaucuccgucguccgcguccagcgccccgccaaguccggcaccgucauggagugcaucucccgccgcgaccagaagcgcuccggccaggucggcaccuacggccucaacaccuucaccaacauggagguccagcucauccgccagauggaguccgagggcaucuucucccccuccgagauggagaacuccaaccucgccgagcgcguccucgacuggcucgagaagcacggcgucgagcgccucaagcgcauggccaucuccggcgacgacugcgucgucaagcccaccgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10622 - RNA, 9879 nt, Artificial Sequence
  derived and/or modified CDS sequence (opt2) from DENV-1__GU131887__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccauccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagauccgcuacgagggcaccgacgcccccugcaagauccccuucuccacccaggacgagcgcggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccuccuucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggcgcuccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccgcccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucggcaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaucaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucgucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10623 - RNA, 9879 nt, Artificial Sequence
  derived and/or modified CDS sequence (opt2) from DENV-1__GU131888__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgaguccgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccauccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuuccucacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccggcugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggccccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgcccucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucggcaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10624 - RNA, 9879 nt, Artificial Sequence
  derived and/or modified CDS sequence (opt2) from DENV-1__GU131892__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccauccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucguccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucggcaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10625 - RNA, 9879 nt, Artificial Sequence
  derived and/or modified CDS sequence (opt2) from DENV-1__GU131893__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccauccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaugaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgccacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggccucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacucccacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcucccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucggcaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgucuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10626 - RNA, 9879 nt, Artificial Sequence
  derived and/or modified CDS sequence (opt2) from DENV-1__GU131894__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccauccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucggcaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccacaaggagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggacccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10627 - RNA, 9879 nt, Artificial Sequence
  derived and/or modified CDS sequence (opt2) from DENV-1__GU131895__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccauccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucgcccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucggcaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccacaaggagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10628 - RNA, 9879 nt, Artificial Sequence
  derived and/or modified CDS sequence (opt2) from DENV-1__GQ868632__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccauccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcgucuccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgagcagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagcgcgaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccuccuuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucggcaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccacaaggagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10629 - RNA, 9879 nt, Artificial Sequence
  derived and/or modified CDS sequence (opt2) from DENV-1__GQ868633__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccauccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucggcaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgaggccaccaagcacgccgucucccgcggccccgccaagcuccgcugguucgucgagcgcaaccucgucaaccccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccacaaggagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugggucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucuggucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10630 - RNA, 9879 nt, Artificial Sequence
  derived and/or modified CDS sequence (opt2) from DENV-1__GU131919__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccauccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuuccucacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucauccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccugcgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccaguccuaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucggcaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10631 - RNA, 9879 nt, Artificial Sequence
  derived and/or modified CDS sequence (opt2) from DENV-1__GU131920__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccauccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgaccgcgagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgccgccuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucggcaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccacaaggagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10632 - RNA, 9879 nt, Artificial Sequence
  derived and/or modified CDS sequence (opt2) from DENV-1__GU131921__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucauggcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccauccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaugaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcgccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagaaggccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucggcaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10633 - RNA, 9879 nt, Artificial Sequence
  derived and/or modified CDS sequence (opt2) from DENV-1__GQ868635__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucauggcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccauccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcgccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagaaggccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucggcaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10634 - RNA, 9879 nt, Artificial Sequence
  derived and/or modified CDS sequence (opt2) from DENV-1__GQ868636__SS-prME
uccgucaccaugcuccucaugcucaugcccaccgcccucgccuuccaccucaccacccgcggcggcgagccccacaugaucgucaccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucauggaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgucggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggccucggcgaggucgacuccuucucccucggccuccucugcaucuccaucaugaucgaggaggucaugcgcucccgcuggucccgcaagaugcucauggccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccacccucucccuccaccacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcgucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccaucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccaccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaucuacaagcgcuccggcaucauggaggucgaccgcuccgaggccaaggagggccucaagcgcggcgagaccacccgccacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaccccccccgagcgcugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccagaaggagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuuccuccccuccgagcucgagacccccaaccucgccgagcgcguccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccuggggcgacguccccuaccucggcaagcgcgaggaccaguggugcggcucccucaucggccucaccgcccgcgccaccugggccuccaacauccaggucgccaucaaccagguccgccgccucaucggcaacgagaacuaccucgacuacaugaccuccaugaagcgcuucaagaacgagggcgaccccgagggcgcccucugguga

SEQ ID NO: 10635 - RNA, 9879 nt, Artificial Sequence
  derived and/or modified CDS sequence (opt2) from DENV-1__GU131922__SS-prME
uccgucaucaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccauccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucggcaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccacaaggagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10636 - RNA, 9879 nt, Artificial Sequence
  derived and/or modified CDS sequence (opt2) from DENV-1__GU131923__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccauccuccgcaagcucugcaucgaggccaagaucuccaacaccaccaccgacucccgcugccccacccagggcgaggccacccucgucgaggagcaggacgccaacuucgucugccgccgcaccgucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcaucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggcaagcgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgaggccgucggcaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10637 - RNA, 9879 nt, Artificial Sequence
  derived and/or modified CDS sequence (opt2) from DENV-1__GQ868637__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggucgagcccgacgacgucgacugcuggugcaacaccaccgacaccugggucaccuacggcaccugcucccagaccggcgagcaccgccgcgacaagcgcuccgucgcccucgccccccacgucggccucggccucgagacccgcgccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggcgccagaucuccaacgagcucaaccacauccuccucgagaacgacaugaaguucaccgucgucgucggcgacgucgucggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagcgcgaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccuccucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccaccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaucgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccuccgccgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgacgagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10638 - RNA, 9879 nt, Artificial Sequence
  derived and/or modified CDS sequence (opt2) from DENV-1__GQ868639__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgaguucugcgaggacaccaugaccuacaagugcccccgcaucuccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccuccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaugaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucgccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgccgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucgucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagaucuccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcgcccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10639 - RNA, 9879 nt, Artificial Sequence
  derived and/or modified CDS sequence (opt2) from DENV-1__GU131925__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccauccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucggcaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10640 - RNA, 9879 nt, Artificial Sequence
  derived and/or modified CDS sequence (opt2) from DENV-1__GU131926__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgaguucugcgaggacaccaugaccuacaagugcccccgcaucuccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccuccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggcgucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaugaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgccgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucgucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagaucuccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcgcccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10641 - RNA, 9879 nt, Artificial Sequence
  derived and/or modified CDS sequence (opt2) from DENV-1__FJ639669__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaagcucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcaccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaggccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcgcccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10642 - RNA, 9882 nt, Artificial Sequence
  derived and/or modified CDS sequence (opt2) from DENV-1__FJ639670__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaagcucaccgucgucgucggcgacgucgccggcauccucgcccagggcaagaagaugauccgcccccagcccauggaguacaaguacuccuggaaguccuggggcaaggccaagaucaucggcgccgacgcccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgucucccgcaagaaccuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggaucgccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccuccuccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcaccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaggccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcgcccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10643 - RNA, 9879 nt, Artificial Sequence
  derived and/or modified CDS sequence (opt2) from DENV-1__FJ639671__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacacccucaccuacaagugcccccgcaucaccgaggucgagcccgacgacgucgacugcuggugcaacaccaccgacaccugggucaccuacggcaccugcucccagaccggcgagcaccgccgcgacaagcgcuccgucgcccucgccccccacgucggccucggccucgagacccgcgccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacggcaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccgucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacgucauguggcgccagaucuccaacgagcucaaccacauccuccucgagaacgacaugaaguucaccgucgucgucggcgacgucgucggcauccucgcccagggcaagaagaugauccgcccccagcccauggagcacaaguacuccuggaaguccuggggcaaggccaagaucaucggcgccgacguccagaacaccaccuucaucaucgacggccccaacaccuccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacucccgcgccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccaguccuaccagcucugggccacccuccucucccucaccuucaucaagaccaccuucucccuccacuacgccuggaagaccauggccaugguccucuccaucgucucccuccucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgagaccaucgagacccucaugcuccucgcccucaucgccguccucaccggcggcgucacccucuucuuccucuccggccgcggccucggcaagaccuccaucggccuccucugcgucauggccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccaccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccuccgccgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10644 - RNA, 9879 nt, Artificial Sequence
  derived and/or modified CDS sequence (opt2) from DENV-1__JN819423__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacacccucaccuacaagugcccccgcaucaccgaggucgagcccgacgacgucgacugcuggugcaacaccaccgacaccugggucaccuacggcaccugcucccagaccggcgagcaccgccgcgacaagcgcuccgucgcccucgccccccacgucggccucggccucgagacccgcgccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacggcaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccgucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacgucauguggcgccagaucuccaacgagcucaaccacauccuccucgagaacgacaugaaguucaccgucgucgucggcgacgucgucggcauccucgcccagggcaagaagaugauccgcccccagcccauggagcacaaguacuccuggaaguccuggggcaaggccaagaucaucggcgccgacguccagaacaccaccuucaucaucgacggccccaacaccuccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacucccgcgccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccaguccuaccagcucugggccacccuccucucccucaccuucaucaagaccaccuucucccuccacuacgccuggaagaccauggccaugguccucuccaucgucucccuccucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgagaccaucgagacccucaugcuccucgcccucaucgccguccucaccggcggcgucacccucuucuuccucuccggccgcggccucggcaagaccuccaucggccuccucugcgucauggccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccaccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccuccgccgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccagcaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10645 - RNA, 9879 nt, Artificial Sequence
  derived and/or modified CDS sequence (opt2) from DENV-1__FJ639672__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucuccucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaagcucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgccuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcaccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaggccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcgcccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10646 - RNA, 9879 nt, Artificial Sequence
  derived and/or modified CDS sequence (opt2) from DENV-1__FJ639673__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggucgagcccgacgacgucgacugcuggugcaacaccaccgacaccugggucaccuacggcaccugcucccagaccggcgagcaccgccgcgacaagcgcuccgucgcccucgccccccacgucggccucggccucgagacccgcgccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggcgccagaucuccaacgagcucaaccacauccuccucgagaacgacaugaaguucaccgucgucgucggcgacgucgucggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgcuccugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccaguccuaccagcucugggccacccuccucucccucaccuucaucaagaccaccuucucccuccacuacgccuggaagaccauggccaugguccucuccaucgucucccuccucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgucgucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccaccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccuccgccgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10647 - RNA, 9879 nt, Artificial Sequence
  derived and/or modified CDS sequence (opt2) from DENV-1__FJ639674__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgaguucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccuccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaugucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgucaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccggccgcguccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10648 - RNA, 9879 nt, Artificial Sequence
  derived and/or modified CDS sequence (opt2) from DENV-1__FJ639675__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgaguucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccuccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggccucuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccuccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaugaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10649 - RNA, 9879 nt, Artificial Sequence
  derived and/or modified CDS sequence (opt2) from DENV-1__FJ639676__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggucgagcccgacgacgucgacugcuggugcaacaccaccgacaccugggucaccuacggcaccugcucccagaccggcgagcaccgccgcgacaagcgcuccgucgcccucgccccccacgccggccucggccucgagacccgcgccgagaccuggauguccuccgagggcgccuggaagcagauccagcgcgucgagaccugggcccuccgccaccccggcuucaccgucaucgcccucuuccucgcccacgucaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggcgccagaucuccaacgagcucaaccacauccuccucgagaacgacaugaaguucaccgucgucgucggcgacgucgucggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucgucggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccaguccuaccagcucugggccacccuccucucccucaccuucaucaagaccaccuucucccuccacuacgccuggaagaccauggccaugguccucuccaucgucucccuccucccccucugccucuccaccaccucccagaagaccaccuggcuccccguccuccucggcucccucggcugcaagccccucaccauguucuucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccaucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccaccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcauccucgaggucgaccgcuccgaggccaaggagggccuccgccgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuucaugaccuccaugaagcgcuucaagaacgaguccgacaccgagggcgcccucugguga

SEQ ID NO: 10650 - RNA, 9879 nt, Artificial Sequence
  derived and/or modified CDS sequence (opt2) from DENV-1__FJ639677__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcgucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaagcucaccgucgucgucggcgacgucgccggcauccucgcccagggcaagaagaugauccgcccccagcccauggaguacaaguacuccuggaaguccuggggcaaggccaagaucaucggcgccgacgcccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccaugggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccucaagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcaccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcuccaagaagccccgcaucugcacccgcgaggaguucauccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaggccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcgcccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10651 - RNA, 9879 nt, Artificial Sequence
  derived and/or modified CDS sequence (opt2) from DENV-1__GQ868618__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgaguucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccuccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10652 - RNA, 9879 nt, Artificial Sequence
  derived and/or modified CDS sequence (opt2) from DENV-1__GQ868619__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaagcucaccgucgucgucggcgacgucgccggcauccucgcccagggcaagaagaugauccgcccccagcccauggaguacaaguacuccuggaaguccuggggcaaggccaagaucaucggcgccgacgcccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgucgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccauggaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccaucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucaugcucuucuuccucuccggccgcggccucggcaagaccuccaucggccuccucugcgucauggccuccuccggccuccucuggauggccuccgucgagccccacuggaucgccgccuccaucauccucgaguucuuccucaugguccuccucauccccgagcccgaccgccagcgcaccccccaggacaaccagcucgccuacgucgucaugggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcaccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaggccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcgcccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10653 - RNA, 9879 nt, Artificial Sequence
  derived and/or modified CDS sequence (opt2) from DENV-1__FJ639678__SS-prME
uccgucaccaugcuccucaugcucaugcccaccgcccucgccuuccaccucaccacccgcggcggcgagccccacaugaucgucuccaagcaggagcgcggcaaggcccuccucuucaagaccuccgccggcgucaacaugugcacccucaucgccauggaccucggcgagcucugcgaggacaccaugaccuacaagugcccccgcaucaccgaggucgagcccgacgacgucgacugcuggugcaacgccaccgacaccugggucaccuacggcaccugcccccagaccggcgagcaccgccgcgaccgccgcuccgucgcccucgccccccacgucggccucggccucgagacccgcgccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgucggcauccucgcccagggcaagaagaugauccgcccccagcccauggaguacaaguacuccuggaaguccuggggcaaggccaagaucaucggcgccgacauccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccuccucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuuccucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccaggagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagaaggcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccaccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccacccgccacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcagggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccgcaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10654 - RNA, 9879 nt, Artificial Sequence
  derived and/or modified CDS sequence (opt2) from DENV-1__FJ639679__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccauccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucggcaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgcccgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10655 - RNA, 9879 nt, Artificial Sequence
  derived and/or modified CDS sequence (opt2) from DENV-1__FJ850069__SS-prME
uccgucaccaugcuccucaugcucaugcccaccgcccucgccuuccaccucaccacccgcggcggcgagccccacaugaucgucggcaagcaggagcgcggcaagucccuccucuucaagaccuccgccggcgucaacaugugcacccucaucgccauggaccucggcgagcucugcgaggacaccaugaccuacaagugcccccgcaucaccgaggucgagcccgacgacgucgacugcuggugcaacaccaccgacaccugggucaccuacggcaccugcucccagaccggcgagcaccgccgcgacaagcgcuccgucgcccucgccccccacgucggccucggccucgagacccgcgccgagaccuggauguccuccgagggcgccuggaagcagauccagcgcgucgagaccugggcccuccgccaccccggcuucaccgucaucgcccucuuccucgcccacgucaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggcgccagaucuccaacgagcucaaccacauccuccucgagaacgacaugaaguucaccgucgucgucggcgacgucgucggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccaguccuaccagcucugggucacccuccucucccucaccuucaucaagaccaccuucucccuccacuacgccuggaagaccauggccaugguccucuccaucgucucccuccucccccucugccucuccaccaccucccagaagaccaccuggcuccccguccuccucggcucccucggcugcaagccccucaccauguucuucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccaucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccaccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcauccucgaggucgaccgcuccgaggccaaggagggccuccgccgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccggcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgacaccgagggcgcccucugguga

SEQ ID NO: 10656 - RNA, 9879 nt, Artificial Sequence
  derived and/or modified CDS sequence (opt2) from DENV-1__FJ639680__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaagcucaccgucgucgucggcgacgucgccggcauccucgcccagggcaagaagaugauccgcccccagcccauggaguacaaguacuccuggaaguccuggggcaaggccaagaucaucggcgccgacgcccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccacaaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcaccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaggccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcgcccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10657 - RNA, 9879 nt, Artificial Sequence
  derived and/or modified CDS sequence (opt2) from DENV-1__FJ639682__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaagacccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaagcucaccgucgucgucggcgacgucgccggcauccucgcccagggcaagaagaugauccgcccccagcccauggaguacaaguacuccuggaaguccuggggcaaggccaagaucaucggcgccgacgcccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacguccucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcauccccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcaccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaggccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcgcccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10658 - RNA, 9879 nt, Artificial Sequence
  derived and/or modified CDS sequence (opt2) from DENV-1__JQ287664__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggucgagcccgacgacgucgacugcuggugcaacaccaccgacaccugggucaccuacggcaccugcucccagaccggcgagcaccgccgcgacaagcgcuccgucgcccucgccccccacgucggccucggccucgagacccgcgccgagaccuggauguccuccgagggcgccuggaagcagauccagcgcgucgagaccugggcccuccgccaccccggcuucaccgucaucgcccucuuccucgcccacgucaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggcgccagaucuccaacgagcucaaccacauccuccucgagaacgacaugaaguucaccgucgucgucggcgacgucgucggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccaguccuaccagcucugggccacccuccucucccucaccuucaucaagaccaccuucucccuccacuacgccuggaagaccauggccaugguccucuccaucgucucccuccucccccucugccucuccaccaccucccagaagaccaccuggcuccccguccuccucggcucccucggcugcaagccccucaccauguucuucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgcaaguaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccaucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccaccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcauccucgaggucgaccgcuccgaggccaaggagggccuccgccgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccuucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgacaccgagggcgcccucugguga

SEQ ID NO: 10659 - RNA, 9879 nt, Artificial Sequence
  derived and/or modified CDS sequence (opt2) from DENV-1__FJ639683__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccauccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccuccuucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaagucccucgucuccgccggcuccggcgaggucgacuccuucucccucggccuccucugcaucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggccacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucggcaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucgucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10660 - RNA, 9879 nt, Artificial Sequence
  derived and/or modified CDS sequence (opt2) from DENV-1__FJ639684__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgaguucugcgaggacaccaugaccuacaagugcccccgcaucuccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccuccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaugaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucgucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagaucuccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcgcccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccguccccgagggcgcccucugguga

SEQ ID NO: 10661 - RNA, 9879 nt, Artificial Sequence
  derived and/or modified CDS sequence (opt2) from DENV-1__FJ639685__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccauccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccuccuucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccggcaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucuccgucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucgucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccauccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10662 - RNA, 9879 nt, Artificial Sequence
  derived and/or modified CDS sequence (opt2) from DENV-1__FJ639686__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccauccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagauccgcuacgagggcaccgacgcccccugcaagauccccuucuccacccaggacgagcgcggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccuccuucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggcgcuccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucggcaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaucaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucgucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10663 - RNA, 9879 nt, Artificial Sequence
  derived and/or modified CDS sequence (opt2) from DENV-1__FJ639687__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgaguucugcgaggacaccaugaccuacaagugcccccgcaucuccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccuccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaugaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgccgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucgucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagaucuccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcgcccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccucaaggagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10664 - RNA, 9879 nt, Artificial Sequence
  derived and/or modified CDS sequence (opt2) from DENV-1__FJ639688__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacgucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaccucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccuccucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagauggccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucuaccagguccgccgccucaucggcaacgagaacuaccucgacuacaugaccuccaugaagcgcuucaagaacgaguccgaccccgagggcgcccucugguga

SEQ ID NO: 10665 - RNA, 9879 nt, Artificial Sequence
  derived and/or modified CDS sequence (opt2) from DENV-1__FJ639689__SS-prME
uccgucaccaugcuccucaugcucaugcccaccgcccucgccuuccaccucaccauccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccauccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccuccuucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggcgcuccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcgucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaccgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccgucggccucucccucgucgccuccgucgagcuccccaacucccucgaggagcucggcgacggccucgccaugggcaucaugauccucaagcuccucaccgacuuccagccccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcgucaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucggcaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaucaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucgucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10666 - RNA, 9879 nt, Artificial Sequence
  derived and/or modified CDS sequence (opt2) from DENV-1__FJ639690__SS-prME
uccgucaccaugcuccucaugcucaugcccaccgcccucgccuuccaccucaccauccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaucggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccauccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccuccuucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggcgcuccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcgucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaccgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccgucggccucucccucgucgccuccgucgagcuccccaacucccucgaggagcucggcgacggccucgccaugggcaucaugauccucaagcuccucaccgacuuccagccccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucggcaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaucaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucgucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10667 - RNA, 9879 nt, Artificial Sequence
  derived and/or modified CDS sequence (opt2) from DENV-1__FJ639691__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgaguucugcgaggacaccaugaccuacaagugcccccgcaucuccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccuccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaugaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccaguccuaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucgucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagaucuccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcacccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccucgagggcgcccucugguga

SEQ ID NO: 10668 - RNA, 9879 nt, Artificial Sequence
  derived and/or modified CDS sequence (opt2) from DENV-1__FJ639692__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgaguccgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccauccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgcccucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucggcaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucaccgaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10669 - RNA, 9879 nt, Artificial Sequence
  derived and/or modified CDS sequence (opt2) from DENV-1__FJ639693__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgaguucugcgaggacaccaugaccuacaagugcccccgcaucuccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccuccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaugaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgccgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccgucggcuuccagaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucgucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagaucuccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcgcccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccggccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10670 - RNA, 9879 nt, Artificial Sequence
  derived and/or modified CDS sequence (opt2) from DENV-1__FJ639694__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccauccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccuccuucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggcgcuccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucggcaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaucaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucgucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccaacuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10671 - RNA, 9879 nt, Artificial Sequence
  derived and/or modified CDS sequence (opt2) from DENV-1__FJ639695__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccauccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaugaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggccucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcucccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucggcaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgucuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10672 - RNA, 9879 nt, Artificial Sequence
  derived and/or modified CDS sequence (opt2) from DENV-1__FJ639696__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgaguucugcgaggacaccaugaccuacaagugcccccgcaucuccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccuccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaugaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucgucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagaucuccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcgcccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccucgagggcgcccucugguga

SEQ ID NO: 10673 - RNA, 9879 nt, Artificial Sequence
  derived and/or modified CDS sequence (opt2) from DENV-1__HM181937__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccauccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucggcaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccacaaggagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacaucgaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10674 - RNA, 9879 nt, Artificial Sequence
  derived and/or modified CDS sequence (opt2) from DENV-1__HM181939__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgaguucugcgaggacaccaugaccuacaagugcccccgcaucuccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccuccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaugaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucgucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccaucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagaucuccggcggcaacauguacgccgacgacaccgccggcugggacacccgcaucaccgaggacgaccuccagaacgaggccaagaucaccgacaucauggagcccgagcacgcccuccucgccaacuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10675 - RNA, 9879 nt, Artificial Sequence
  derived and/or modified CDS sequence (opt2) from DENV-1__HM181942__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgaguucugcgaggacaccaugaccuacaagugcccccgcaucuccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccuccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaugaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucgucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagaucuccggcggcaacauguacgccgacgacaccgccggcugggacacccgcaucaccgaggacgaccuccagaacgaggccaagaucaccgacaucauggagcccgagcacgcccuccucgccaacuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10676 - RNA, 9879 nt, Artificial Sequence
  derived and/or modified CDS sequence (opt2) from DENV-1__HM488255__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgaguccgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccauccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucggcaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggccgcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10677 - RNA, 9879 nt, Artificial Sequence
  derived and/or modified CDS sequence (opt2) from DENV-1__HM181944__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucuccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccuccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaugaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucgucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagaucuccggcggcaacauguacgccgacgacaccgccggcugggacacccgcaucaccgaggacgaccuccagaacgaggccaagaucaccgacaucauggagcccgagcacgcccuccucgccaacuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10678 - RNA, 9879 nt, Artificial Sequence
  derived and/or modified CDS sequence (opt2) from DENV-1__HM181946__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccauccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagauccgcuacgagggcaccgacgcccccugcaagauccccuucuccacccaggacgagcgcggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccuccuucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggcgcuccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucggcaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucgucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10679 - RNA, 9879 nt, Artificial Sequence
  derived and/or modified CDS sequence (opt2) from DENV-1__HM181948__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggucgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccauccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucggcaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10680 - RNA, 9879 nt, Artificial Sequence
  derived and/or modified CDS sequence (opt2) from DENV-1__HM181949__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccauccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccggccacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucggcaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggccgcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10681 - RNA, 9879 nt, Artificial Sequence
  derived and/or modified CDS sequence (opt2) from DENV-1__HM181950__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccauccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcgccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucggcaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacucccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10682 - RNA, 9879 nt, Artificial Sequence
  derived and/or modified CDS sequence (opt2) from DENV-1__HM181952__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgagaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucguccagggcaagaagaugauccgcccccagcccauggaguacaaguacuccuggaaguccuggggcaaggccaagaucaucggcgccgacguccagaacuccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgccaaggccuccuucaucgaggucaagaccugcaucuggcccaagucccacacccucugguccaacggcguccucgaguccgagaugaucauccccaagauccacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccaguccuaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucuggcacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccauggaggccuucccccaguccaacgccgucauccaggacgaggagcgcgacauccccgagcgcuccuggaacuccggcuacgaguggaucaccgacuuccccggcaagaccgucugguucguccccuccaucaaggccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucgucggccccggccuccaggccaaggccacccgcgaggcccagaagcgcaccgccgccggcaucaugaagaaccccaccaucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgaccgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuuccuccccaacgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccgcaucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuacuccgacuacaugaccuccaugaagcgcuucaagaacgaguccgagcccgagggcgcccucugguga

SEQ ID NO: 10683 - RNA, 9879 nt, Artificial Sequence
  derived and/or modified CDS sequence (opt2) from DENV-1__HM181953__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccauccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucguccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucggcaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaagcucgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10684 - RNA, 9879 nt, Artificial Sequence
  derived and/or modified CDS sequence (opt2) from DENV-1__KF921933__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccauccuccgcaagcucugcaucgaggccaagaucuccaacaccaccaccgacuccaagugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccucggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucggcaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacggccgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10685 - RNA, 9879 nt, Artificial Sequence
  derived and/or modified CDS sequence (opt2) from DENV-1__HM181954__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccauccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggacccccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcgccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggccugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucggcaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10686 - RNA, 9879 nt, Artificial Sequence
  derived and/or modified CDS sequence (opt2) from DENV-1__HM181955__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgaguccgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccauccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgucgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucggcaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10687 - RNA, 9879 nt, Artificial Sequence
  derived and/or modified CDS sequence (opt2) from DENV-1__HM181959__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgaguccgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccauccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaaggucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgucgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucggcaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10688 - RNA, 9879 nt, Artificial Sequence
  derived and/or modified CDS sequence (opt2) from DENV-1__JF937651__SS-prME
uccgucaccaugcuccucaugcucaugcccaccgcccucgccuuccaccucaccacccgcggcggcgagccccacaugauccucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccauccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucauccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccugcgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccaguccuaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucggcaaccaccaccacgccgccaugcucgacgucgaccuccaccccgccuccgccuggacccucuacgccgucgccaccaccaucaucacccccaugaugaagcacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucaccggcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccaagggcgcccucugguga

SEQ ID NO: 10689 - RNA, 9879 nt, Artificial Sequence
  derived and/or modified CDS sequence (opt2) from DENV-1__GU131956__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccagaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaccaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccauccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcaccuccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacaaccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgccuccaucaugaucgaggaggucaugcgcucccgcuggucccgcaagaugcucaugaccggcacccucgccgucuuccuccuccucgucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucaucaagaccacccucucccucgacuacgccuggaagaccaccgccauggcccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcaccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaugguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccaccagcacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgagaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10690 - RNA, 9879 nt, Artificial Sequence
  derived and/or modified CDS sequence (opt2) from DENV-1__GU131958__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccagaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccauccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcaccuccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacaaccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgccuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucaucaagaccacccucucccucgacuacgccuggaagaccaccgccauggcccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcaccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccaccagcacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuucgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10691 - RNA, 9879 nt, Artificial Sequence
  derived and/or modified CDS sequence (opt2) from DENV-1__GQ868499__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccagaucaccgaggccgagcccgacgacgucgacugcuggugcaacgccaccgacaccugggucaccuacggcaccugcucccagaccggcggccaccgccgcgagaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcaccuccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacaaccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgccuccaucaugaucgaggaggucaugcgcucccgcuggucccgcaagaugcucaugaccggcacccucgccgucuuccuccuccucaucaugggccagcucaccuggaaggaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccucccucgagcuccccaacucccucgaggagcucggcgacggccucgccaugggcaucaugaugcucaagcuccucaccgaguuccagccccaccagcucuggaccacccuccucucccucaccuucaucaagaccacccucucccucgacuacgccuggaagaccaccgccauggcccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggucgccgaggucuccugggagcaggaggccgagcacuccggcaccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccaccagcacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10692 - RNA, 9879 nt, Artificial Sequence
  derived and/or modified CDS sequence (opt2) from DENV-1__GQ868500__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccagaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccauccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcaccuccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacaaccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgccuccaucaugaucgaggaggucaugcgcucccgcuggucccgcaagaugcucaugaccggcacccucgccgucuuccuccuccucgucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucaucaagaccacccucucccucgacuacgccuggaagaccaccgccauggcccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcaccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaugguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucgucauccucaccgucgccgccaacgagaugggccuccucgagaccaccaagaaggaccucggcaucggccacgucgccgccgagaaccaccagcacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucaagcagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucggcgagaaccaguggaacuccgccaaggaggccgucgaggacgagcgcgucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgagaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10693 - RNA, 9879 nt, Artificial Sequence
  derived and/or modified CDS sequence (opt2) from DENV-1__GU131961__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccagaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccauccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcaccuccuacgucaugugcaccggcuccuuccgccucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacaaccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgccuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucaucaagaccacccucucccucgacuacgccuggaagaccaccgccauggcccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcaccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccaccagcacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuucgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcguccucugguga

SEQ ID NO: 10694 - RNA, 9870 nt, Artificial Sequence
  derived and/or modified CDS sequence (opt2) from DENV-1__GU131962__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccagaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccauccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcaccuccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacaaccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggucccgcaagaugcucaugaccggcacccucgccgucuuccuccuccucgucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucaucaagaccacccucucccucgacuacgccuggaagaccaccgccauggcccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcaccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccaccagcacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaguacgccuccgccggccucgccaucaucgucccccucccccucgacaccuacggccgcaaccgccucaagauccacuccggcaaggacgucuucuucaugccccccgagaagggcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgaggcccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgagaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10695 - RNA, 9879 nt, Artificial Sequence
  derived and/or modified CDS sequence (opt2) from DENV-1__GU131963__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccagaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgccuucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccauccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcaccuccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacaaccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggucccgcaagaugcucaugaccggcacccucgccgucuuccuccuccucgucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucaucaagaccacccucucccucgacuacgccuggaagaccaccgccauggcccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcaccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccaccagcacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgaggcccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgagaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccaggucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10696 - RNA, 9879 nt, Artificial Sequence
  derived and/or modified CDS sequence (opt2) from DENV-1__KF955442__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccagaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccauccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcaccuccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacaaccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgacggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgccuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucaucaagaccacccucucccucgacuacgccuggaagaccaccgccauggcccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcaccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccaccagcacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuucgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10697 - RNA, 9879 nt, Artificial Sequence
  derived and/or modified CDS sequence (opt2) from DENV-1__GU131965__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccagaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccuggguccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccauccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcaccuccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcaacaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacaaccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgccaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgccuccaucaugaucgaggaggucaugcgcucccgcuggucccgcaagaugcucaugaccggcacccucgccgucuuccuccuccucgucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucaucaagaccacccucucccucgacuacgccuggaagaccaccgccauggcccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcaccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccaccagcacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgagaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10698 - RNA, 9879 nt, Artificial Sequence
  derived and/or modified CDS sequence (opt2) from DENV-1__GU131966__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccagaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccauccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcaccuccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacaaccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgccuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucaucaagaccacccucucccucgacuacgccuggaagaccaccgccauggcccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcaccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccaccagcacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuaccgccgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuucgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10699 - RNA, 9879 nt, Artificial Sequence
  derived and/or modified CDS sequence (opt2) from DENV-1__GQ868501__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccagaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccauccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcaccuccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacaaccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgccuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucaucaagaccacccucucccucgacuacgccuggaagaccaccgccauggcccucuccaucgucucccucuucccccucugccucuccaccaccucccagaagaccaccuggcuccccguccuccucggcuccuucggcugcaagccccucaccauguuccucaucaccgagaaccagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaagaccgccgaggucuccugggagcaggaggccgagcacuccggcaccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccaccagcacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccucauggccaccuacggcuggaaccucgucgagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuucgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10700 - RNA, 9879 nt, Artificial Sequence
  derived and/or modified CDS sequence (opt2) from DENV-1__HQ166035__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccagaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccauccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccgccucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcaccuccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacaaccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggucccgcaagaugcucaugaccggcacccucgccgucuuccuccuccucgucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucaucaagaccacccucucccucgacuacgccuggaagaccaccgccauggcccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcaccucccacaacauccucgucgagguccaggacgacggcaccaugaagaucaaggacgaggagcgcgacgacacccucaccauccuccucaaggccaccaugcucgccgucuccggcgucuaccccauguccauccccgccacccccuucgucugguacuucuggcagaagaagaagcagcgcauccgcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgaggagaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccaccagcacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgaggcccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgagaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10701 - RNA, 9879 nt, Artificial Sequence
  derived and/or modified CDS sequence (opt2) from DENV-1__GQ868502__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccagaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaccaucuucauccuccucaugcucgccacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccauccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaccguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcaccuccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacaaccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgccuccaucaugaucgaggaggucaugcgcucccgcuggucccgcaagaugcucaugaccggcacccucgccgucuuccuccuccucgucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucaucaagaccacccucucccucgacuacgccuggaagaccaccgccauggcccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcaccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaugguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccaccagcacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgagaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10702 - RNA, 9879 nt, Artificial Sequence
  derived and/or modified CDS sequence (opt2) from DENV-1__GQ868503__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccagaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccauccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcaccuccuacgucaugugcaccggcuccuucaagcucgagaaggaggucgccgagacccagcacggcaccguccucguccaggucaaguacgagggcaccgacgcccccugcaagauccccuucuccacccagaacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacaaccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgagcgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgccuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucaucaagaccacccucucccucgacuacgccuggaagaccaccgccauggcccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcaccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagcgcaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaucuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccaccagcacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuucgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10703 - RNA, 9879 nt, Artificial Sequence
  derived and/or modified CDS sequence (opt2) from DENV-1__GQ868504__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccagaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccauccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcaccuccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacaaccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggucccgcaagaugcucaugaccggcacccucgccgucuuccuccuccucgucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucaucaagaccacccucucccucgacuacgccuggaagaccaccgccauggcccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcaccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaagggcgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguaccccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccaccagcacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgaggcccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgagaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10704 - RNA, 9879 nt, Artificial Sequence
  derived and/or modified CDS sequence (opt2) from DENV-1__GU131967__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccagaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccauccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcaccuccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacaaccagcgcgccuggaacaucugggaggucgaggacuacggcuucggcaucuucaccaccaacaucuggcucaagcuccgcgacuccuacacccagaccugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggucccgcaagaugcucaugaccggcacccucgccgucuuccuccuccucgucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucaucaagaccacccucucccucgacuacgccuggaagaccaccgccauggcccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcaccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccaccagcacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacggcgagcccaucccccucgccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgaggcccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgagaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10705 - RNA, 9879 nt, Artificial Sequence
  derived and/or modified CDS sequence (opt2) from DENV-1__GU131968__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccagaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccauccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcaccuccuacgucaugugcaccggcuccuucaagcucgagaaggaggucgccgagacccagcacggcaccguccucguccaggucaaguacgagggcaccgacgcccccugcaagauccccuucuccacccagaacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacaaccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgagcgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgccuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucaucaagaccacccucucccucgacuacgccuggaagaccaccgccauggcccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcaccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagcgcaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccaccagcacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuucgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10706 - RNA, 9879 nt, Artificial Sequence
  derived and/or modified CDS sequence (opt2) from DENV-1__GQ868506__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccagaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgccuucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccauccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcaccuccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacaaccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggucccgcaagaugcucaugaccggcacccucgccgucuuccuccuccucgucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucaucaagaccacccucucccucgacuacgccuggaagaccaccgccauggcccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcaccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccggccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccaccagcacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgaggcccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgagaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10707 - RNA, 9879 nt, Artificial Sequence
  derived and/or modified CDS sequence (opt2) from DENV-1__GQ868507__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccagaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccauccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcaccuccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacaaccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgccuccaucaugaucgaggaggucaugcgcucccgcuggucccgcaagaugcucaugaccggcacccucgccgucuuccuccuccucgucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaucacccuccucucccucaccuucaucaagaccacccucucccucgacuacgccuggaagaccaccgccauggcccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcaccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccaugcccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaugguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccaccagcacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccccuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgagaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10708 - RNA, 9879 nt, Artificial Sequence
  derived and/or modified CDS sequence (opt2) from DENV-1__GQ868508__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccagaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccauccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcaccuccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacaaccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgccuccaucaugaucgaggaggucaugcgcucccgcuggucccgcaagaugcucaugaccggcacccucgccgucuuccuccuccucgucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaucacccuccucucccucaccuucaucaagaccacccucucccucgacuacgccuggaagaccaccgccauggcccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcaccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccaugcccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaugguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccaccagcacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgagaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10709 - RNA, 9879 nt, Artificial Sequence
  derived and/or modified CDS sequence (opt2) from DENV-1__GQ868509__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccagaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccauccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagauguccggcaccaccaccaucuucgccggccaccucaagugccgccucaagauggacaagcucacccucaagggcaccuccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgucacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacaaccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgccuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucaucaagaccacccucucccucgacuacgccuggaagaccaccgccauggcccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcaccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuuccucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccaccagcacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuucgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10710 - RNA, 9879 nt, Artificial Sequence
  derived and/or modified CDS sequence (opt2) from DENV-1__GQ868510__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccagaucaccgaggccgagcccgacgacgucgacugcuggugcaacgccaccgacaccugggucaccuacggcaccugcucccagaccggcggccaccgccgcgagaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccauccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcaccuccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacauccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgccuccaucaugaucgaggaggucaugcgcucccgcuggucccgcaagaugcucaugaccggcacccucgccgucuuccuccuccucaucaugggccagcucaccuggaaggaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucaucaagaccacccucucccucgacuacgccuggaagaccaccgccauggcccucuccaucgucucccucuucccccucugccucuccaccaccucccagaagaccaccuggcuccccguccuccucggcucccucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcaccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccaccagcacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucggcaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10711 - RNA, 9879 nt, Artificial Sequence
  derived and/or modified CDS sequence (opt2) from DENV-1__GQ868511__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccagaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccauccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaccugccgccucaagauggacaagcucacccucaagggcaccuccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacaaccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgccuccaucaugaucgaggaggucaugcgcucccgcuggucccgcaagaugcucaugaccggcacccucgccgucuuccuccuccucgucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucaucaagaccacccucucccucgacuacgccuggaagaccaccgccauggcccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcaccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagaagaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccaccagcacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacgccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgaguccuucugggaccucguccacaaggagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgagaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacaugggcguccagcucauccgccagauggaguccgagggcaucuuccuccccuccgagcucgagacccccaaccucgccgagcgcguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10712 - RNA, 9879 nt, Artificial Sequence
  derived and/or modified CDS sequence (opt2) from DENV-1__GQ868512__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccagaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccauccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcaccuccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacaaccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggucccgcaagaugcucaugaccggcacccucgccgucuuccuccuccucgucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucaucaagaccacccucucccucgacuacgccuggaagaccaccgccauggcccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcaccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccaccagcacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgaggcccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgagaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 10713 - RNA, 9879 nt, Artificial Sequence
  derived and/or modified CDS sequence (opt2) from DENV-1__GU131970__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccagaucaccgaggccgagcccgacgacgucgacugcuggugcaacgccaccgacaccugggucaccuacggcaccugcucccagaccggcgagcaccgccgcgagaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccauccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcaccuccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaccauccgcccccagcccauggagcacaaguacuccuggaaguccuggggcaaggccaagaucaucggcgccgacauccagaacaccaccuucaucaucgacggccccgacacccccgagugccccgacaaccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggucccgcaagaugcucaugaccggcacccucgccgucuuccuccuccucaucaugggccagcucaccuggaaggaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccacccccaccagcucuggaccacccuccucucccucaccuucaucaagaccacccucucccucgacuacgccuggaagaccaccgccauggcccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcaccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccaccagcacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccucaaggagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga
